(12) United States Patent
Raitano et al.

(10) Patent No.: US 8,212,017 B2
(45) Date of Patent: Jul. 3, 2012

(54) NUCLEIC ACIDS AND CORRESPONDING PROTEINS ENTITLED 158P3D2 USEFUL IN TREATMENT AND DETECTION OF CANCER

(75) Inventors: Arthur B. Raitano, Los Angeles, CA (US); Aya Jakobovits, Beverly Hills, CA (US); Pia M. Challita-Eid, Encino, CA (US); Steven B. Kanner, Santa Monica, CA (US); Wangmao Ge, Tampa, FL (US); Juan J. Perez-Villar, Santa Monica, CA (US); Robert Kendall Morrison, Santa Monica, CA (US)

(73) Assignee: Agensys, Inc., Santa Monica, CA (US)

( * ) Notice: Subject to any disclaimer, the term of this patent is extended or adjusted under 35 U.S.C. 154(b) by 0 days.

(21) Appl. No.: 12/899,433

(22) Filed: Oct. 6, 2010

(65) Prior Publication Data

US 2011/0082095 A1  Apr. 7, 2011

Related U.S. Application Data

(63) Continuation of application No. 10/994,106, filed on Nov. 19, 2004, now Pat. No. 7,811,575, which is a continuation-in-part of application No. 10/107,532, filed on Mar. 25, 2002, now abandoned.

(60) Provisional application No. 60/283,112, filed on Apr. 10, 2001, provisional application No. 60/286,630, filed on Apr. 25, 2001.

(51) Int. Cl.
*C07H 21/04* (2006.01)
*C12N 15/00* (2006.01)

(52) U.S. Cl. .................... 536/23.5; 435/320.1

(58) Field of Classification Search ................ None
See application file for complete search history.

(56) References Cited

U.S. PATENT DOCUMENTS 5,599,677 A     2/1997  Dowell et al.
2003/0232350 A1  12/2003  Afar et al.

FOREIGN PATENT DOCUMENTS

| WO | WO-01/38523  | 5/2001 |
| WO | WO-01/57273  | 8/2001 |
| WO | WO-02/083928 | 10/2002 |
| WO | WO 02/083928 | * 10/2002 |
| WO | WO-03/003906 | 1/2003 |

OTHER PUBLICATIONS

Alberts et al., Molecular Biology of the Cell, 3rd edition (1994) p. 465.
Boon, Adv. Can. Res. (1992) 58:177-210.
Bork, Genome Research (2000) 10:398-400.
Bowie et al., Science (1990) 257:1306-1310.
Brennan et al., J. Autoimm. (1989) 2:Suppl:177-186.
Burchardt et al., Clinical Chemistry (2000) 46(5):595-605.
Burgess et al., J. Cell Biol. (1990) 111:2129-2138.
Carrere et al., Gut (1999) 44:550-551.
Celis, J. of Clinical Investigation (2002) 110:1765-1768.
Chaux et al., Int. J. Cancer (1998) 77:538-542.
Curti, Crit. Rev. in Oncology/Hematology (1993) 14:29-39.
EBI Accession No. GSP:ADN39478.
EBI Accession No. GSP:ABB04709.
EBI Accession No. GSP:AAB94661.
EBI Accession No. GSP:AAG64606.
EBI Accession No. UNIPROT:09GZ09 (2001).
EBI Accession No. UNIPROT:09H448 (2001).
EBI Accession No. UNIPROT:Q9GZQ9 (2001).
EBI Accession No. UNIPROT:Q9H448 (2001).
Eriksson et al., Diabetologia (1992) 35:143-147.
Fu et al., EMBO J. (1996) 15:4392-4401.
Greenbaum et al., Genome Biology (2003) 4(9):117.1-117.8.
Guo et al., J. Pharm. Exp. Ther. (2002) 300:206-212.
Hell et al., Laboratory Investigation (1995) 73:492-496.
International Search Report for PCT/US02/09403, mailed on Mar. 26, 2003, 3 pages.
International Search Report for PCT/US2004/039083, mailed on Aug. 16, 2005, 6 pages.
Jain, Sci. Am. (1994) 271:58-65.
Jang, Clin. Exp. Med. (1997) 15:469-483.
Javanbakh et al., JBC (2003) 27644-27651.
Kirkin et al., APMIS (1998) 106:665-679.
Lawrie et al., J. Clinical Pathology: Mol. Pathol. (2001) 54:253-258.
Lazar et al., Mol. Cell. Biol. (1988) 8:1247-1252.
Lewin, Genes VI, Oxford University Press, Inc., New York (1997) Ch. 29.
Mallampalli et al., Biochem. J. (1996) 318:333-341.
McClean and Hill, Eur. J. Cancer (1993) 29A:2243-2248.
Powell et al., Pharmacogenesis (1998) 8:411-421.
Scott et al., Nature Genetics (1999) 21:440-443.
Shantz and Pegg, Int. J. Biochem. Cell Biol. (1999) 31:107-122.
Supplementary Partial European Search Report for EP 02 72 8582, mailed on Feb. 15, 2005, 5 pages.
Tockman et al., Cancer Res. (1992) 52:2711s-2718s.
Vallejo et al., Biochimie (2000) 82:1129-1133.
Zimmer, Cell Motility and the Cytoskeleton (1991) 20:325-337.
Chen et al., Molecular and Cellular Proteomics (2002) 1:304.
Dermer, Bio/Technology (1994) 12:320.
Freshney, Culture of Animal Cells, A Manual of Basic Technique, Alan R. Liss, Inc., New York (1983) p. 4.
Gura, Science (1997) 278:1041-1042.

* cited by examiner

*Primary Examiner* — Laura B Goddard
(74) *Attorney, Agent, or Firm* — Morrison & Foerster LLP

(57) ABSTRACT

A novel gene 158P3D2 and its encoded protein, and variants thereof, are described wherein 158P3D2 exhibits tissue specific expression in normal adult tissue, and is aberrantly expressed in the cancers listed in Table I. Consequently, 158P3D2 provides a diagnostic, prognostic, prophylactic and/or therapeutic target for cancer. The 158P3D2 gene or fragment thereof, or its encoded protein, or variants thereof, or a fragment thereof, can be used to elicit a humoral or cellular immune response; antibodies or T cells reactive with 158P3D2 can be used in active or passive immunization.

8 Claims, 158 Drawing Sheets

Figure 1: 158P3D2 SSH sequence of 312 nucleotides. (SEQ ID NO: 1)

```
  1 GATCTCTTCA CATGNAGATT GACATCTTTC CTCAAGATGT GCCTGCTCCA CCCCCAGTTG
 61 ACATCAAGCC TCGGCAGCCA ATCAGCTATG AGCTCAGAGT TGNCATCTGG AACACGGAGG
121 ATGTGGTTCT GGATGACGAG AATCCACTCA CCGGAGAGAT GTCGAGNGAC ATCTATGTGA
181 AGAGCTGGGT GAAGNNNNTG GAGCATGACA AGCAGGAGAC AGACGTTCAC TTCAACTCCC
241 TGACTGTGGA GGGGAACTTC AATTGNNGCT TTGNGCTCCG CTTTGACTAC CTGCCCACGG
301 AGCGGGAGGA TC
```

Figure 2

Figure 2A. The cDNA (SEQ ID NO:2) and amino acid sequence (SEQ ID NO:3) of 158P3D2 v.1 clone 158P3D2-BCP1.

```
  1 ttttttttatgaaacagtctcgctctgtctcccaggttggagtgcagtggcacgatctcgg
 61 ctgactgcaacctccacctctgggttcaagcgattctcctgcctcagcctcccagtag
121 ctgggattacaggcgtgggccccatgtccagctaattttatattttcgctctgtctcc
181 caggttggagtgcagtggcacgatctcggctgactgcaacctccacctctgggttcaag
241 cgattctcctgcctcagcctcccagtagctgggattacaggcgtgggccccatgtcca
301 gctaattttatattttagtagagacagggtttcaccatgttgtccaggctggtcttga
361 accctgacctcaagtgatccaccacctctgcctcccaaagtgctgggattacaggtgt
421 gagccaccatgccaggccctcttaacctcttcaagtctgttttctcatctgcaaaacaga
481 ggtaataagatcagtatcttcttaatggaagcacctggactacatttttttcattcattg
541 ttatcataaatgaggactaacctgtctcccgttgggagttttgaacctagacctcatgtc
601 ttcatgacgtcatcactgccccaggcccagctgtgtcctacaccagcccagctgacgc
661 atcttctttttctgcctgtagagatggttacaatgcctggcgtgatgcattctggccttc
721 gcagatcctggcggggctgtgccaacgctgtggcctcctgccctgaataccgagccgg
781 tgctgtcaaggtgggcagcaaagtcttcctgacaccaccggagaccctgcccccagggat
             M  W  I  D  I  F  P  Q  D  V  P  A  P  P  P  V  D  I
841 ctcttcacATGTGGATTGACATCTTTCCTCAAGATGTGCCTGCTCCACCCCCAGTTGACA
 19  K  P  R  Q  P  I  S  Y  E  L  R  V  V  I  W  N  T  E  D  V
901 TCAAGCCTCGGCAGCCAATCAGCTATGAGCTCAGAGTTGTCATCTGGAACACGGAGGATG
 39  V  L  D  D  E  N  P  L  T  G  E  M  S  S  D  I  Y  V  K  S
961 TGGTTCTGGATGACGAGAATCCACTCACCGGAGAGATGTCGAGTGACATCTATGTGAAGA
 59  W  V  K  G  L  E  H  D  K  Q  E  T  D  V  H  F  N  S  L  T
1021 GCTGGGTGAAGGGGTTGGAGCATGACAAGCAGGAGACAGACGTTCACTTCAACTCCCTGA
 79  G  E  G  N  F  N  W  R  F  V  F  R  F  D  Y  L  P  T  E  R
1081 CTGGGGAGGGGAACTTCAATTGGCGCTTTGTGTTCCGCTTTGACTACCTGCCCACGGAGC
 99  E  V  S  V  W  R  R  S  G  P  F  A  L  E  E  A  E  F  R  Q
1141 GGGAGGTGAGCGTCTGGCGCAGGTCTGGACCCTTTGCCCTGGAGGAGGCGGAGTTCCGGC
119  P  A  V  L  V  L  Q  V  W  D  Y  D  R  I  S  A  N  D  F  L
1201 AGCCTGCAGTGCTGGTCCTGCAGGTCTGGGACTATGACCGCATCTCTGCCAATGACTTCC
139  G  S  L  E  L  Q  L  P  D  M  V  R  G  A  R  G  P  E  L  C
1261 TTGGATCCCTGGAGTTGCAGCTACCAGACATGGTGCGTGGGGCCCGGGGCCCCGAGCTCT
159  S  V  Q  L  A  R  N  G  A  G  P  R  C  N  L  F  R  C  R  R
1321 GCTCTGTGCAGCTGGCCCGCAATGGGGCCGGGCCGAGGTGCAATCTGTTTCGCTGCCGCC
179  L  R  G  W  W  P  V  V  K  L  K  E  A  E  D  V  E  R  E  A
1381 GCCTGAGGGGCTGGTGGCCGGTAGTGAAGCTGAAGGAGGCAGAGGACGTGGAGCGGGAGG
199  Q  E  A  Q  A  G  K  K  K  R  Q  R  R  R  K  G  R  P  E
```

Figure 2A-2

```
1441 CGCAGGAGGCTCAGGCTGGCAAGAAGAAGCGAAAGCAGAGGAGGAGGAAGGGCCGGCCAG
 219    D  L  E  F  T  D  M  G  G  N  V  Y  I  L  T  G  K  V  E  A
1501 AAGACCTGGAGTTCACAGACATGGGTGGCAATGTGTACATCCTCACGGGCAAGGTGGAGG
 239    E  F  E  L  L  T  V  E  E  A  E  K  R  P  V  G  K  G  R  K
1561 CAGAGTTTGAGCTGCTGACTGTGGAGGAGGCCGAGAAACGGCCAGTGGGGAAGGGGCGGA
 259    Q  P  E  P  L  E  K  P  S  R  P  K  T  S  F  N  W  F  V  N
1621 AGCAGCCAGAGCCTCTGGAGAAACCCAGCCGCCCCAAAACTTCCTTCAACTGGTTTGTGA
 279    P  L  K  T  F  V  F  F  I  W  R  R  Y  W  R  T  L  V  L  L
1681 ACCCGCTGAAGACCTTTGTCTTCTTCATCTGGCGCCGGTACTGGCGCACCCTGGTGCTGC
 299    L  L  V  L  L  T  V  F  L  L  L  V  F  Y  T  I  P  G  Q  I
1741 TGCTACTGGTGCTGCTCACCGTCTTCCTCCTCCTGGTCTTCTACACCATCCCTGGCCAGA
 319    S  Q  V  I  F  R  P  L  H  K  *
1801 TCAGCCAGGTCATCTTCCGTCCCCTCCACAAGTGActctcgctgaccttggacactcacc
1861 cagggtgccaacccttcaatgcctgctcctggaagtctttcttacccatgtgagctaccc
1921 cagagtctagtgcttcctctgaataaacctatcacagccacaaaaaaaaaaaaaaaaaaa
1981 aaaaaaaaaaaaaa
```

Figure 2B. The cDNA (SEQ ID NO:4) and amino acid sequence (SEQ ID NO:5) of 158P3D2 v.2A.

```
   1 atcaaggccctgggctggaggaagacatcccagatccagaggagctcgactgggggtcca
   1                                                           M  D
  61 agtactatgcgtcgctgcaggagctccaggggcagcacaactttgatgaagatgaaATGG
   3    D  P  G  D  S  D  G  V  N  L  I  S  M  V  G  E  I  Q  D  Q
 121 ATGATCCTGGAGATTCAGATGGGGTCAACCTCATTTCTATGGTTGGGGAGATCCAAGACC
  23    G  E  A  E  V  K  G  T  V  S  P  K  K  A  V  A  T  L  K  I
 181 AGGGTGAGGCTGAAGTCAAAGGCACTGTGTCCCCAAAAAAAGCAGTTGCCACCCTGAAGA
  43    Y  N  R  S  L  E  E  F  N  H  F  E  D  W  L  N  V  F  P
 241 TCTACAACAGGTCCCTGGAGGAAGAATTTAACCACTTTGAAGACTGGCTGAATGTGTTTC
  63    L  Y  R  G  Q  G  G  Q  D  G  G  E  E  G  S  G  H  L
 301 CTCTGTACCGAGGGCAAGGGGGCCAGGATGGAGGTGGAGAAGAGGAAGGATCTGGACACC
  83    V  G  K  F  K  G  S  F  L  I  Y  P  E  S  E  A  V  L  F  S
 361 TTGTGGGCAAGTTCAAGGGCTCCTTCCTCATTTACCCTGAATCAGAGGCAGTGTTGTTCT
 103    E  P  Q  I  S  R  G  I  P  Q  N  R  P  I  K  L  L  V  R  V
 421 CTGAGCCCCAGATCTCTCGGGGATCCCACAGAACCGGCCCATCAAGCTCCTGGTCAGAG
 123    Y  V  V  K  A  T  N  L  A  P  A  D  P  N  G  K  A  D  P  Y
 481 TGTATGTTGTAAAGGCTACCAACCTGGCTCCTGCACACCCCAATGGCAAAGCAGACCCTT
 143    V  V  V  S  A  G  R  E  R  Q  D  T  K  E  R  Y  I  P  K  Q
```

Figure 2B-2

```
 541 ACGTGGTGGTGAGCGCTGGCCGGGAGCGGCAGGACACCAAGGAACGCTACATCCCCAAGC
 163    L  N  P  I  F  G  E  I  L  E  L  S  I  S  L  P  A  E  T  E
 601 AGCTCAACCCCATCTTTGGAGAGATCCTGGAGCTAAGCATCTCTCTCCCAGCTGAGACGG
 183    L  T  V  A  V  F  E  H  D  L  V  G  S  D  D  L  I  G  E  T
 661 AGCTGACGGTCGCCGTATTTGAACATGACCTCGTGGGTTCTGACGACCTCATCGGGGAGA
 203    H  I  D  L  E  N  R  F  Y  S  H  H  R  A  N  C  G  L  A  S
 721 CCCACATTGATCTGGAAAACCGATTCTATAGCCACCACAGAGCAAACTGTGGGCTGGCCT
 223    Q  Y  E  V  W  V  Q  Q  G  P  Q  E  P  F  *
 781 CCCAGTATGAAGTGTGGGTCCAGCAGGGCCCACAGGAGCCATTCTGAgtttctggccaaa
 841 cacattcaagctcacattccttttgtgtctccagatcctatgatttcatggaaggggac
 901 cctcccacccaccgccactgccaaccaagacatagctcagtggtcaagacttgggcttgg
 961 gagtcgggatcctgtaacgaatgtcacttgaccgctttcttttttttatgaaacagtctcg
1021 ctctgtctcccaggttggagtgcagtggcacgatctcggctgactgcaacctccacctcc
1081 tgggttcaagcgattctcctgcctcagcctccccagtagctgggattacaggcgtgggcc
1141 cccatgtccagctaattttatattttcgctctgtctcccaggttggagtgcagtggcac
1201 gatctcggctgactgcaacctccacctcctgggttcaagcgattctcctgcctcagcctc
1261 cccagtagctgggattacaggcgtgggcccccatgtccagctaattttatattttagt
1321 agagacagggtttcaccatgttgtccaggctggtcttgaaccccgacctcaagtgatcc
1381 acccacctctgcctcccaaagtgctgggattacaggtgtgagccaccatgccaggccctc
1441 ttaacctcttcaagtctgttttctcatctgcaaaacagaggtaataagatcagtatcttc
1501 ttaatggaagcacctgggctacatttttttcattcattgttatcataaatgaggactaac
1561 ctgtctcccgttggagttttgaacctagacctcatgtcttcatgacgtcatcactgccc
1621 caggcccagctgtgtccctacaccagccccagctgacgcatcttcttttctgcctgtag
1681 agatggttacaatgcctggcgtgatgcattctggccttcgcagatcctggcggggctgtg
1741 ccaacgctgtggcctccctgcccctgaataccgagccggtgctgtcaaggtgggcagcaa
1801 agtcttcctgacaccaccggagaccctgcccccagggatctcttcacatgtggattgaca
1861 tctttcctcaagatgtgcctgctccaccccagttgacatcaagcctcggcagccaatca
1921 gctatgagctcagagttgtcatctggaacacggaggatgtggttctggatgacgagaatc
1981 cactcaccggagagatgtcgagtgacatctatgtgaagagctgggtgaaggggttggagc
2041 atgacaagcaggagacagacgttcacttcaactccctgactggggagggaacttcaatt
2101 ggcgctttgtgttccgctttgactacctgcccacggagcgggaggtgagcgtctggcgca
2161 ggtctggaccctttgccctggaggaggcggagttccggcagcctgcagtgctggtcctgc
2221 aggatccctggagttgcagctaccagacatggtgcgtggggcccggggccccgagctctg
2281 ctctgtgcagctggcccgcaatggggccgggccgaggtgcaatctgtttcgctgccgccg
2341 cctgaggggctggtggccggtagtgaagctgaaggaggcagaggacgtggagcgggaggc
2401 gcaggaggctcaggctggcaagaagaagcgaaagcagaggaggaggaagggccggccaga
2461 agacctggagttcacagacatgggtggcaatgtgtacatcctcacgggcaaggtggaggc
2521 agagtttgagctgctgactgtggaggaggccgagaaacggccagtggggaaggggcggaa
2581 gcagccagagcctctggagaaacccagccgccccaaaaacttccttcaactggtttgtgaa
```

Figure 2B-3

```
2641 cccgctgaagacctttgtcttcttcatctggcgccggtactggcgcaccctggtgctgct
2701 gctactggtgctgctcaccgtcttcctcctcctggtcttctacaccatccctggccagat
2761 cagccaggtcatcttccgtcccctccacaagtgactctcgctgaccttggacactcaccc
2821 agggtgccaacccttcaatgcctgctcctggaagtctttcttacccatgtgagctacccc
2881 agagtctagtgcttcctctgaataaacctatcacagcc
```

Figure 2C. The cDNA (SEQ ID NO:6) and amino acid sequence (SEQ ID NO:7) of 158P3D2 v.2B.

```
   1 atcaaggccctgggctggaggaagacatcccagatccagaggagctcgactgggggtcca
  61 agtactatgcgtcgctgcaggagctccagggcagcacaactttgatgaagatgaaatgg
 121 atgatcctggagattcagatggggtcaacctcatttctatggttggggagatccaagacc
 181 agggtgaggctgaagtcaaaggcactgtgtcccaaaaaaagcagttgccaccctgaaga
 241 tctacaacaggtccctgcaggaagaatttaaccactttgaagactggctgaatgtgtttc
 301 ctctgtaccgagggcaaggggccaggatggaggtggagaagaggaaggatctggacacc
 361 ttgtgggcaagttcaagggctccttcctcatttaccctgaatcagaggcagtgttgttct
 421 ctgagcccagatctctcggggatcccacagaaccggcccatcaagctcctggtcagag
 481 tgtatgttgtaaaggctaccaacctggctcctgcagaccccaatggcaaagcagacccctt
 541 acgtggtggtgagcgctggccgggagcggcaggacaccaaggaacgctacatccccaagc
 601 agctcaaccccatctttggagagatcctggagctaagcatctctctcccagctgagacgg
 661 agctgacggtcgcgtatttgaacatgacctcgtgggtctgacgacctcatcggggaga
 721 cccacattgatctggaaaaccgattctatagccaccacagagcaaactgtgggctggcct
 781 cccagtatgaagtgtgggtccagcagggcccacaggagccattctgagtttctggccaaa
 841 cacattcaagctcacattcccttttgtgtctccagatcctatgatttcatggaaggggac
 901 cctcccacccaccgccactgccaaccaagacatagctcagtggtcaagacttgggcttgg
 961 gagtcgggatcctgtaacgaatgtcacttgaccgcttctttttttatgaaacagtctcg
1021 ctctgtctcccaggttggagtgcagtggcacgatctcggctgactgcaacctccacctcc
1081 tgggttcaagcgattctcctgcctcagcctcccagtagctgggattacaggcgtgggcc
1141 cccatgtccagctaattttatattttcgctctgtctcccaggttggagtgcagtggcac
1201 gatctcggctgactgcaacctccacctcctgggttcaagcgattctcctgcctcagcctc
1261 cccagtagctgggattacaggcgtgggcccccatgtccagctaattttatattttttagt
1321 agagacagggtttcaccatgttgtccaggctggtcttgaaccctgacctcaagtgatcc
1381 acccacctctgcctcccaaagtgctgggattacaggtgtgagccaccatgccaggccctc
1441 ttaacctcttcaagtctgttttctcatctgcaaaacagaggtaataagatcagtatcttc
1501 ttaatgaagcacctgggctacattttttcattcattgttatcataaatgaggactaac
1561 ctgtctcccgttgggagttttgaacctagacctcatgtcttcatgacgtcatcactgccc
1621 caggcccagctgtgtccctacaccagcccagctgacgcatcttcttttttctgcctgtag
1681 agatggttacaatgcctggcgtgatgcattctggccttcgcagatcctggcggggctgtg
```

Figure 2C-2

```
1741 ccaacgctgtggcctccctgccctgaataccgagccggtgctgtcaaggtgggcagcaa
1801 agtcttcctgacaccaccggagaccctgccccagggatctcttcacatgtggattgaca
1861 tctttcctcaagatgtgcctgctccaccccagttgacatcaagcctcggcagccaatca
1921 gctatgagctcagagttgtcatctggaacacggaggatgtggttctggatgacgagaatc
1981 cactcaccggagagatgtcgagtgacatctatgtgaagagctgggtgaaggggttggagc
2041 atgacaagcaggagacagacgttcacttcaactccctgactggggagggaacttcaatt
2101 ggcgctttgtgttccgctttgactacctgcccacggagcgggaggtgagcgtctggcgca
2161 ggtctggaccctttgcctggaggaggcggagttccggcagcctgcagtgctggtcctgc
   1                                        M  V  R  G  A  R  G  P  E  L  C
2221 aggatccctggagttgcagctaccagacATGGTGCGTGGGGCCCGGGGCCCCGAGCTCTG
  12  S  V  Q  L  A  R  N  G  A  G  P  R  C  N  L  F  C  R  R
2281 CTCTGTGCAGCTGGCCCGCAATGGGGCCGGGCCGAGGTGCAATCTGTTTCGCTGCCGCCG
  32  L  R  G  W  W  P  V  V  K  L  K  E  A  E  D  V  E  R  E  A
2341 CCTGAGGGGCTGGTGGCCGGTAGTGAAGCTGAAGGAGGCAGAGGACGTGGAGCGGGAGGC
  52  Q  E  A  Q  A  G  K  K  K  R  K  Q  R  R  R  K  G  R  P  E
2401 GCAGGAGGCTCAGGCTGGCAAGAAGAAGCGAAAGCAGAGGAGGAGGAAGGGCCGGCCAGA
  72  D  L  E  F  T  D  M  G  G  N  V  Y  I  L  T  G  K  V  E  A
2461 AGACCTGGAGTTCACAGACATGGGTGGCAATGTGTACATCCTCACGGGCAAGGTGGAGGC
  92  E  F  E  L  L  T  V  E  E  A  E  K  R  F  V  G  K  G  R  K
2521 AGAGTTTGAGCTGCTGACTGTGGAGGAGGCCGAGAAACGGCCAGTGGGGAAGGGCGGAA
 112  Q  P  E  P  L  E  K  P  S  R  P  K  T  S  F  N  W  F  V  N
2581 GCAGCCAGAGCCTCTGGAGAAACCCAGCCGCCCCAAAACTTCCTTCAACTGGTTTGTGAA
 132  P  L  K  T  F  V  F  F  I  W  R  R  Y  W  R  T  L  V  L  L
2641 CCCGCTGAAGACCTTTGTCTTCTTCATCTGGCGCCGGTACTGGCGCACCCTGGTGCTGCT
 152  L  V  L  L  T  V  F  L  L  L  V  F  Y  T  I  P  G  Q  I
2701 GCTACTGGTGCTGCTCACCGTCTTCCTCCTCCTGGTCTTCTACACCATCCCTGGCCAGAT
 172  S  Q  V  I  F  R  P  L  H  K  *
2761 CAGCCAGGTCATCTTCCGTCCCCTCCACAAGTGActctcgctgaccttggacactcaccc
2821 agggtgccaaccttcaatgcctgctcctggaagtctttcttacccatgtgagctacccc
2881 agagtctagtgcttcctctgaataaacctatcacagcc
```

Figure 2D. The cDNA (SEQ ID NO:8) and amino acid sequence (SEQ ID NO:9) of 158P3D2 v.3.

```
  1 ttttttatgaaacagtctcgctctgtctcccaggttggagtgcagtggcacgatctcgg
 61 ctgactgcaacctccacctcctgggttcaagcgattctcctgcctcagcctccccagtag
121 ctgggattacaggcgtgggccccatgtccagctaattttatattttcgctctgtctcc
181 caggttggagtgcagtggcacgatctcggctgactgcaacctccacctcctgggttcaag
```

Figure 2D-2

```
 241 cgattctcctgcctcagcctccccagtagctgggattacaggcgtgggcccccatgtcca
 301 gctaattttttatattttttagtagagacagggtttcaccatgttgtccaggctggtcttga
 361 acccctgacctcaagtgatccacccacctctgcctcccaaagtgctgggattacaggtgt
 421 gagccaccatgccaggccctcttaacctcttcaagtctgttttctcatctgcaaaacaga
 481 ggtaataagatcagtatcttcttaatggaagcacctggactacattttttttcattcattg
 541 ttatcataaatgaggactaacctgtctcccgttgggagttttgaacctagacctcatgtc
 601 ttcatgacgtcatcactgccccaggcccagctgtgtccctacaccagcccagctgacgc
 661 atcttcttttctgcctgtagagatggttacaatgcctggcgtgatgcattctggccttc
 721 gcagatcctggcggggctgtgccaacgctgtggcctccctgcccctgaataccgagccgg
 781 tgctgtcaaggtgggcagcaaagtcttcctgacaccaccggagaccctgcccccagggat
   1        M  W  I  D  I  F  P  Q  D  V  P  A  P  P  P  V  D  I
 841 ctcttcacATGTGGATTGACATCTTTCCTCAAGATGTGCCTGCTCCACCCCCAGTTGACA
  19   K  P  R  Q  P  I  S  Y  E  L  R  V  V  I  W  N  T  E  D  V
 901 TCAAGCCTCGGCAGCCAATCAGCTATGAGCTCAGAGTTGTCATCTGGAACACGGAGGATG
  39   V  L  D  D  E  N  P  L  T  G  E  M  S  S  D  I  Y  V  K  S
 961 TGGTTCTGGATGACGAGAATCCACTCACCGGAGAGATGTCGAGTGACATCTATGTGAAGA
  59   W  V  K  G  L  E  H  D  K  Q  E  T  D  V  H  F  N  S  L  T
1021 GCTGGGTGAAGGGGTTGGAGCATGACAAGCAGGAGACAGACGTTCACTTCAACTCCCTGA
  79   G  E  G  N  F  N  W  R  F  V  F  R  F  D  Y  L  P  T  E  R
1081 CTGGGGAGGGGAACTTCAATTGGCGCTTTGTGTTCCGCTTTGACTACCTGCCCACGGAGC
  99   E  V  S  V  R  R  R  S  G  P  F  A  L  E  E  A  E  F  R  Q
1141 GGGAGGTGAGCGTCCGGCGCAGGTCTGGACCCTTTGCCCTGGAGGAGGCGGAGTTCCGGC
 119   P  A  V  L  V  L  Q  V  W  D  Y  D  R  I  S  A  N  D  F  L
1201 AGCCTGCAGTGCTGGTCCTGCAGGTCTGGGACTATGACCGCATCTCTGCCAATGACTTCC
 139   G  S  L  E  L  Q  L  P  D  M  V  R  G  A  R  G  P  E  L  C
1261 TTGGATCCCTGGAGTTGCAGCTACCAGACATGGTGCGTGGGGCCCGGGGCCCCGAGCTCT
 159   S  V  Q  L  A  R  N  G  A  G  P  R  C  N  L  F  R  C  R  R
1321 GCTCTGTGCAGCTGGCCCGCAATGGGGCCGGGCCGAGGTGCAATCTGTTTCGCTGCCGCC
 179   L  R  G  W  W  P  V  V  K  L  K  E  A  E  D  V  E  R  E  A
1381 GCCTGAGGGGCTGGTGGCCGGTAGTGAAGCTGAAGGAGGCAGAGGACGTGGAGCGGGAGG
 199   Q  E  A  Q  A  G  K  K  K  R  K  Q  R  R  R  K  G  R  P  E
1441 CGCAGGAGGCTCAGGCTGGCAAGAAGAAGCGAAAGCAGAGGAGGAGGAAGGGCCGGCCAG
 219   D  L  E  F  T  D  M  G  G  N  V  Y  I  L  T  G  K  V  E  A
1501 AAGACCTGGAGTTCACAGACATGGGTGGCAATGTGTACATCCTCACGGGCAAGGTGGAGG
 239   E  F  E  L  L  T  V  E  E  A  E  K  R  P  V  G  K  R  K
1561 CAGAGTTTGAGCTGCTGACTGTGGAGGAGGCCGAGAAACGGCCAGTGGGGAAGGGGCGGA
 259   Q  P  E  F  L  E  K  P  S  R  P  K  T  S  F  N  W  F  V  N
1621 AGCAGCCAGAGCCTCTGGAGAAACCCAGCCGCCCCAAAACTTCCTTCAACTGGTTTGTGA
 279   P  L  K  T  F  V  F  F  I  W  R  R  Y  W  R  T  L  V  L  L
```

Figure 2D-3

```
1681 ACCCGCTGAAGACCTTTGTCTTCTTCATCTGGCGCCGGTACTGGCGCACCCTGGTGCTGC
 299    L  L  V  L  L  T  V  F  L  L  L  V  F  Y  T  I  P  G  Q  I
1741 TGCTACTGGTGCTGCTCACCGTCTTCCTCCTCCTGGTCTTCTACACCATCCCTGGCCAGA
 319    S  Q  V  I  F  R  P  L  H  K  *
1801 TCAGCCAGGTCATCTTCCGTCCCCTCCACAAGTGActctcgctgaccttggacactcacc
1861 cagggtgccaacccttcaatgcctgctcctggaagtctttcttacccatgtgagctaccc
1921 cagagtctagtgcttcctctgaataaacctatcacagccacaaaaaaaaaaaaaaaaaaa
1981 aaaaaaaaaaaaaa
```

Figure 2E. The cDNA (SEQ ID NO:10) and amino acid sequence (SEQ ID NO:11) of 158P3D2 v.4.

```
   1 tttttttatgaaacagtctcgctctgtctcccaggttggagtgcagtggcacgatctcgg
  61 ctgactgcaacctccacctcctgggttcaagcgattctcctgcctcagcctcccagtag
 121 ctgggattacaggcgtgggcccccatgtccagctaattttatattttcgctctgtctcc
 181 caggttggagtgcagtggcacgatctcggctgactgcaacctccacctcctgggttcaag
 241 cgattctcctgcctcagcctcccagtagctgggattacaggcgtgggcccccatgtcca
 301 gctaattttatattttagtagagacagggtttcaccatgttgtccaggctggtcttga
 361 acccctgacctcaagtgatccacccacctctgcctcccaaagtgctgggattacaggtgt
 421 gagccaccatgccaggccctcttaacctcttcaagtctgttttctcatctgcaaacaga
 481 ggtaataagatcagtatcttcttaatggaagcacctggactacattttttcattcattg
 541 ttatcataaatgaggactaacctgtctcccgttgggagttttgaacctagacctcatgtc
 601 ttcatgacgtcatcactgccccaggccagctgtgtccctacaccagccccagctgacgc
 661 atcttcttttctgcctgtagagatggttacaatgcctggcgtgatgcattctggccttc
 721 gcagatcctggcggggctgtgccaacgctgtggcctccctgcccctgaataccgagccgg
 781 tgctgtcaaggtgggcagcaaagtcttcctgacaccaccggagaccctgcccccagggat
   1        M  W  I  D  I  F  P  Q  D  V  P  A  P  P  P  V  D  I
 841 ctcttcacATGTGGATTGACATCTTTCCTCAAGATGTGCCTGCTCCACCCCCAGTTGACA
  19    K  P  R  Q  P  I  S  Y  E  L  R  V  V  I  W  N  T  E  D  V
 901 TCAAGCCTCGGCAGCCAATCAGCTATGAGCTCAGAGTTGTCATCTGGAACACGGAGGATG
  39    V  L  D  D  E  N  P  L  T  G  E  M  S  S  D  I  Y  V  K  S
 961 TGGTTCTGGATGACGAGAATCCACTCACCGGAGAGATGTCGAGTGACATCTATGTGAAGA
  59    W  V  K  G  L  E  H  D  K  Q  E  T  D  V  H  F  N  S  L  T
1021 GCTGGGTGAAGGGGTTGGAGCATGACAAGCAGGAGACAGACGTTCACTTCAACTCCCTGA
  79    G  E  G  N  F  N  W  R  F  V  F  R  F  D  Y  L  P  T  E  R
1081 CTGGGGAGGGGAACTTCAATTGGCGCTTTGTGTTCCGCTTTGACTACCTGCCCACGGAGC
  99    E  V  S  I  W  R  R  S  G  P  F  A  L  E  E  A  E  F  R  Q
1141 GGGAGGTGAGCATCTGGCGCAGGTCTGGACCCTTTGCCCTGGAGGAGGCGGAGTTCCGGC
```

Figure 2E-2

```
 119       P   A   V   L   V   L   Q   V   W   D   Y   D   R   I   S   A   N   D   F   L
1201 AGCCTGCAGTGCTGGTCCTGCAGGTCTGGGACTATGACCGCATCTCTGCCAATGACTTCC
 139       G   S   L   E   L   Q   L   P   D   M   V   R   G   A   R   G   P   E   L   C
1261 TTGGATCCCTGGAGTTGCAGCTACCAGACATGGTGCGTGGGGCCCGGGGCCCCGAGCTCT
 159       S   V   Q   L   A   R   N   G   A   G   P   R   C   N   L   F   R   C   R   R
1321 GCTCTGTGCAGCTGGCCCGCAATGGGGCCGGGCCGAGGTGCAATCTGTTTCGCTGCCGCC
 179       L   R   G   W   W   P   V   V   K   L   K   E   A   E   D   V   E   R   E   A
1381 GCCTGAGGGGCTGGTGGCCGGTAGTGAAGCTGAAGGAGGCAGAGGACGTGGAGCGGGAGG
 199       Q   E   A   Q   A   G   K   K   K   R   K   Q   R   R   R   K   G   R   P   E
1441 CGCAGGAGGCTCAGGCTGGCAAGAAGAAGCGAAAGCAGAGGAGGAGGAAGGGCCGGCCAG
 219       D   L   E   F   T   D   M   G   G   N   V   Y   I   L   T   G   K   V   E   A
1501 AAGACCTGGAGTTCACAGACATGGGTGGCAATGTGTACATCCTCACGGGCAAGGTGGAGG
 239       E   F   E   L   L   T   V   E   E   A   E   K   R   P   V   G   K   G   R   K
1561 CAGAGTTTGAGCTGCTGACTGTGGAGGAGGCCGAGAAACGGCCAGTGGGGAAGGGGCGGA
 259       Q   P   E   P   L   E   K   P   S   R   P   K   T   S   F   N   W   F   V   N
1621 AGCAGCCAGAGCCTCTGGAGAAACCCAGCCGCCCCAAAACTTCCTTCAACTGGTTTGTGA
 279       P   L   K   T   F   V   F   F   I   W   R   R   Y   W   R   T   L   V   L   L
1681 ACCCGCTGAAGACCTTTGTCTTCTTCATCTGGCGCCGGTACTGGCGCACCCTGGTGCTGC
 299       L   L   V   L   L   T   V   F   L   L   L   V   F   Y   T   I   P   G   Q   I
1741 TGCTACTGGTGCTGCTCACCGTCTTCCTCCTCCTGGTCTTCTACACCATCCCTGGCCAGA
 319       S   Q   V   I   F   R   P   L   H   K   *
1801 TCAGCCAGGTCATCTTCCGTCCCCTCCACAAGTGActctcgctgaccttggacactcacc
1861 cagggtgccaacccttcaatgcctgctcctggaagtctttcttacccatgtgagctaccc
1921 cagagtctagtgcttcctctgaataaacctatcacagccacaaaaaaaaaaaaaaaaaaa
1981 aaaaaaaaaaaaaa
```

Figure 2F. The cDNA (SEQ ID NO:12) and amino acid sequence (SEQ ID NO:13) of 158P3D2 v.5A clone 158P3D2-BCP2.

```
   1 tttttttatgaaacagtctcgctctgtctcccaggttggagtgcagtggcacgatctcgg
  61 ctgactgcaacctccacctcctgggttcaagcgattctcctgcctcagcctcccagtag
 121 ctgggattacaggcgtgggccccatgtccagctaattttatattttcgctctgtctcc
 181 caggttggagtgcagtggcacgatctcggctgactgcaacctccacctcctgggttcaag
 241 cgattctcctgcctcagcctcccagtagctgggattacaggcgtgggccccatgtcca
 301 gctaattttatattttagtagagacagggtttcaccatgttgtccaggctggtcttga
 361 accctgacctcaagtgatccacccacctctgcctcccaaagtgctgggattacaggtgt
 421 gagccaccatgccaggccctcttaacctcttcaagtctgttttctcatctgcaaaacaga
 481 ggtaataagatcagtatcttcttaatggaagcacctggactacattttttcattcattg
```

Figure 2F-2

```
 541 ttatcataaatgaggactaacctgtctcccgttgggagttttgaacctagacctcatgtc
 601 ttcatgacgtcatcactgccccaggcccagctgtgtccctacaccagccccagctgacgc
 661 atcttcttttctgcctgtagagatggttacaatgcctggcgtgatgcattctggccttc
 721 gcagatcctggcggggctgtgccaacgctgtggcctccctgcccctgaataccgagccgg
 781 tgctgtcaaggtgggcagcaaagtcttcctgacaccaccggagaccctgcccccagggat
   1                M  W  I  D  I  F  P  Q  D  V  P  A  P  P  P  V  D  I
 841 ctcttcacATGTGGATTGACATCTTTCCTCAAGATGTGCCTGCTCCACCCCCAGTTGACA
  19  K  P  R  Q  P  I  S  Y  E  L  R  V  V  I  W  N  T  E  D  L
 901 TCAAGCCTCGGCAGCCAATCAGCTATGAGCTCAGAGTTGTCATCTGGAACACGGAGGATT
  39  V  L  D  D  E  N  P  L  T  G  E  M  S  S  D  I  Y  V  K  S
 961 TGGTTCTGGATGACGAGAATCCACTCACCGGAGAGATGTCGAGTGACATCTATGTGAAGA
  59  W  V  K  G  L  E  H  D  K  Q  E  T  D  V  H  F  N  S  L  T
1021 GCTGGGTGAAGGGGTTGGAGCATGACAAGCAGGAGACAGACGTTCACTTCAACTCCCTGA
  79  G  E  G  N  F  N  W  R  F  V  F  R  F  D  Y  L  P  T  E  R
1081 CTGGGGAGGGGAACTTCAATTGGCGCTTTGTGTTCCGCTTTGACTACCTGCCCACGGAGC
  99  E  V  S  V  W  R  R  S  G  P  F  A  L  E  E  A  E  F  R  Q
1141 GGGAGGTGAGCGTCTGGCGCAGGTCTGGACCCTTTGCCCTGGAGGAGGCGGAGTTCCGGC
 119  P  A  V  L  V  L  Q  V  W  D  Y  T  A  S  L  P  M  T  S  L
1201 AGCCTGCAGTGCTGGTCCTGCAGGTCTGGGACTATACCGCATCTCTGCCAATGACTTCCT
 139  D  P  W  S  C  S  Y  Q  T  W  C  V  G  P  A  P  S  S  A
1261 TGGATCCCTGGAGTTGCAGCTACCAGACATGGTGCGTGGGGCCCGGGGCCCCGAGCTCTG
 159  L  C  S  W  P  A  M  G  P  G  R  G  A  I  C  F  A  A  A  A
1321 CTCTGTGCAGCTGGCCCGCAATGGGGCCGGGCCGAGGTGCAATCTGTTTCGCTGCCGCCG
 179  *
1381 CCTGAggggctggtggccggtagtgaagctgaaggaggcagaggacgtggagcgggaggc
1441 gcaggaggctcaggctggcaagaagaagcgaaagcagaggaggaggaagggccggccaga
1501 agacctggagttcacagacatgggtggcaatgtgtacatcctcacgggcaaggtggaggc
1561 agagtttgagctgctgactgtggaggaggccgagaaacggccagtggggaaggggcggaa
1621 gcagccagagcctctggagaaacccagccgccccaaaacttccttcaactggtttgtgaa
1681 cccgctgaagacctttgtcttcttcatctggcgccggtactggcgcaccctggtgctgct
1741 gctactggtgctgctcaccgtcttcctcctcctggtcttctacaccatccctggccagat
1801 cagccaggtcatcttccgtcccctccacaagtgactctcgctgaccttggacactcaccc
1861 agggtgccaaccccttcaatgcctgctcctggaagtcttttcttacccatgtgagctaccccc
1921 agagtctagtgcttcctctgaataaacctatcacagccacaaaaaaaaaaaaaaaaaaaaa
1981 aaaaaaaaaaaa
```

Figure 2G. The cDNA (SEQ ID NO:14) and amino acid sequence (SEQ ID NO:15) of 158P3D2 v.5B clone 158P3D2-BCP2.

```
   1 ttttttttatgaaacagtctcgctctgtctcccaggttggagtgcagtggcacgatctcgg
  61 ctgactgcaacctccacctcctgggttcaagcgattctcctgcctcagcctcccagtag
 121 ctgggattacaggcgtgggcccccatgtccagctaattttatattttcgctctgtctcc
 181 caggttggagtgcagtggcacgatctcggctgactgcaacctccacctcctgggttcaag
 241 cgattctcctgcctcagcctcccagtagctgggattacaggcgtgggcccccatgtcca
 301 gctaattttatattttagtagagacagggtttcaccatgttgtccaggctggtcttga
 361 accctgacctcaagtgatccacccacctctgcctcccaaagtgctgggattacaggtgt
 421 gagccaccatgccaggccctcttaacctcttcaagtctgttttctcatctgcaaaacaga
 481 ggtaataagatcagtatcttcttaatggaagcacctggactacatttttttcattcattg
 541 ttatcataaatgaggactaacctgtctcccgttgggagttttgaacctagacctcatgtc
 601 ttcatgacgtcatcactgccccaggcccagctgtgtccctacaccagcccagctgacgc
 661 atcttcttttctgcctgtagagatggttacaatgcctggcgtgatgcattctggccttc
 721 gcagatcctggcggggctgtgccaacgctgtggcctccctgcccctgaataccgagccgg
 781 tgctgtcaaggtgggcagcaaagtcttcctgacaccaccggagacctgcccccaggat
 841 ctcttcacatgtggattgacatctttcctcaagatgtgcctgctccaccccagttgaca
 901 tcaagcctcggcagccaatcagctatgagctcagagttgtcatctggaacacggaggatt
 961 tggttctggatgacgagaatccactcaccggagagatgtcgagtgacatctatgtgaaga
1021 gctgggtgaaggggttggagcatgacaagcaggagacagacgttcacttcaactccctga
1081 ctggggaggggaacttcaattggcgctttgtgttccgctttgactacctgcccacggagc
1141 gggaggtgagcgtctggcgcaggtctggacccttgccctggaggaggcggagttccggc
1201 agcctgcagtgctggtcctgcaggtctgggactataccgcatctctgccaatgacttcct
   1                                             M  V  R  G  A  R  G  P  E  L  C
1261 tggatccctggagttgcagctaccagacATGGTGCGTGGGGCCCGGGGCCCCGAGCTCTG
  12  S  V  Q  L  A  R  N  G  A  G  P  R  C  N  L  F  R  C  R  R
1321 CTCTGTGCAGCTGGCCCGCAATGGGGCCGGGCCGAGGTGCAATCTGTTTCGCTGCCGCCG
  32  L  R  G  W  W  P  V  V  K  L  E  A  E  D  V  E  R  E  A
1381 CCTGAGGGGCTGGTGGCCGGTAGTGAAGCTGAAGGAGGCAGAGGACGTGGAGCGGGAGGC
  52  Q  E  A  Q  A  G  K  K  K  R  Q  R  R  R  K  G  R  P  E
1441 GCAGGAGGCTCAGGCTGGCAAGAAGAAGCGAAAGCAGAGGAGGAGGAAGGGCCGGCCAGA
  72  D  L  E  F  T  D  M  G  G  N  V  Y  I  L  T  G  K  V  E  A
1501 AGACCTGGAGTTCACAGACATGGGTGGCAATGTGTACATCCTCACGGGCAAGGTGGAGGC
  92  E  F  E  L  L  T  V  E  E  A  E  K  R  P  V  G  K  G  R  K
1561 AGAGTTTGAGCTGCTGACTGTGGAGGAGGCCGAGAAACGGCCAGTGGGGAAGGGGCGGAA
 112  Q  P  E  P  L  E  K  P  S  R  P  K  T  S  F  N  W  F  V  N
1621 GCAGCCAGAGCCTCTGGAGAAACCCAGCCGCCCCAAAACTTCCTTCAACTGGTTTGTGAA
 132  P  L  K  T  F  V  F  F  I  W  R  R  Y  W  R  T  L  V  L  L
1681 CCCGCTGAAGACCTTTGTCTTCTTCATCTGGCGCCGGTACTGGCGCACCCTGGTGCTGCT
```

Figure 2G-2

```
152        L   L   V   L   L   T   V   F   L   L   L   V   F   Y   T   I   P   G   Q   I
1741 GCTACTGGTGCTGCTCACCGTCTTCCTCCTCCTGGTCTTCTACACCATCCCTGGCCAGAT
172        S   Q   V   I   F   R   P   L   H   K   *
1801 CAGCCAGGTCATCTTCCGTCCCCTCCACAAGTGActctcgctgaccttggacactcaccc
1861 agggtgccaacccttcaatgcctgctcctggaagtctttcttacccatgtgagctacccc
1921 agagtctagtgcttcctctgaataaacctatcacagccacaaaaaaaaaaaaaaaaaaaa
1981 aaaaaaaaaaaaa
```

Figure 2H. The cDNA (SEQ ID NO:16) and amino acid sequence (SEQ ID NO:17) of 158P3D2 v.6.

```
   1 ttttttatgaaacagtctcgctctgtctcccaggttggagtgcagtggcacgatctcgg
  61 ctgactgcaacctccacctcctgggttcaagcgattctcctgcctcagcctcccagtag
 121 ctgggattacaggcgtgggccccatgtccagctaattttatattttcgctctgtctcc
 181 caggttggagtgcagtggcacgatctcggctgactgcaacctccacctcctgggttcaag
 241 cgattctcctgcctcagcctcccagtagctgggattacaggcgtgggccccatgtcca
 301 gctaattttatattttagtagagacagggtttcaccatgttgtccaggctggtcttga
 361 accctgacctcaagtgatccacccacctctgcctcccaaagtgctgggattacaggtgt
 421 gagccaccatgccaggccctcttaacctcttcaagtctgttttctcatctgcaaaacaga
 481 ggtaataagatcagtatcttcttaatggaagcacctgggctacatttttttcattcattg
 541 ttatcataaatgaggactaacctgtctcccgttgggagttttgaacctagacctcatgtc
 601 ttcatgacgtcatcactgcccaggccagctgtgtccctacaccagcccagctgacgc
 661 atcttcttttctgcctgtagagatggttacaatgcctggcgtgatgcattctggccttc
 721 gcagatcctggcgggctgtgccaacgctgtggcctccctgccctgaataccgagccgg
 781 tgctgtcaaggtgggcagcaaagtcttcctgacaccaccggagaccctgcccccagggat
   1             M   W   I   D   I   F   P   Q   D   V   P   A   P   P   P   V   D   I
 841 ctcttcacATGTGGATTGACATCTTTCCTCAAGATGTGCCTGCTCCACCCCCAGTTGACA
  19   K   P   R   Q   P   I   S   Y   E   L   R   V   V   I   W   N   T   E   D   V
 901 TCAAGCCTCGGCAGCCAATCAGCTATGAGCTCAGAGTTGTCATCTGGAACACGGAGGATG
  39   V   L   D   D   E   N   P   L   T   G   E   M   S   S   D   I   Y   V   K   S
 961 TGGTTCTGGATGACGAGAATCCACTCACCGGAGAGATGTCGAGTGACATCTATGTGAAGA
  59   W   V   K   G   L   E   H   D   K   Q   E   T   D   V   H   F   N   S   L   T
1021 GCTGGGTGAAGGGGTTGGAGCATGACAAGCAGGAGACAGACGTTCACTTCAACTCCCTGA
  79   G   E   G   N   F   N   W   R   F   V   F   R   F   D   Y   L   P   T   E   R
1081 CTGGGGAGGGGAACTTCAATTGGCGCTTTGTGTTCCGCTTTGACTACCTGCCCACGGAGC
  99   E   V   S   V   W   R   R   S   G   P   F   A   L   E   E   A   E   F   R   Q
1141 GGGAGGTGAGCGTCTGGCGCAGGTCTGGACCCTTTGCCCTGGAGGAGGCGGAGTTCCGGC
 119   P   A   V   L   V   L   Q   V   W   D   Y   D   R   I   S   A   N   D   F   L
```

Figure 2H-2

```
1201 AGCCTGCAGTGCTGGTCCTGCAGGTCTGGGACTATGACCGCATCTCTGCCAATGACTTCC
 139    G  S  L  E  Q  L  P  D  M  V  R  G  A  R  G  P  E  L  C
1261 TTGGATCCCTGGAGTTGCAGCTACCAGACATGGTGCGTGGGGCCCGGGGCCCCGAGCTCT
 159    S  V  Q  L  A  R  N  G  A  G  P  R  C  N  L  F  R  C  R  R
1321 GCTCTGTGCAGCTGGCCCGCAATGGGGCCGGGCCGAGGTGCAATCTGTTTCGCTGCCGCC
 179    L  R  G  W  W  P  V  V  K  L  E  A  E  D  V  E  R  E  A
1381 GCCTGAGGGGCTGGTGGCCGGTAGTGAAGCTGAAGGAGGCAGAGGACGTGGAGCGGGAGG
 199    Q  E  A  Q  A  G  K  K  K  R  K  Q  R  R  R  K  G  R  P  E
1441 CGCAGGAGGCTCAGGCTGGCAAGAAGAAGCGAAAGCAGAGGAGGAGGAAGGGCCGGCCAG
 219    D  L  E  F  T  D  M  G  G  N  V  Y  I  L  T  G  K  V  E  A
1501 AAGACCTGGAGTTCACAGACATGGGTGGCAATGTGTACATCCTCACGGGCAAGGTGGAGG
 239    E  F  E  L  L  T  V  E  E  A  E  K  R  P  V  G  K  G  R  K
1561 CAGAGTTTGAGCTGCTGACTGTGGAGGAGGCCGAGAAACGGCCAGTGGGGAAGGGGCGGA
 259    Q  P  E  P  L  E  K  P  S  R  P  K  T  S  F  N  W  F  V  N
1621 AGCAGCCAGAGCCTCTGGAGAAACCCAGCCGCCCCAAAACTTCCTTCAACTGGTTTGTGA
 279    P  L  K  T  F  V  F  F  I  W  R  R  Y  W  R  T  L  V  L  L
1681 ACCCGCTGAAGACCTTTGTCTTCTTCATCTGGCGCCGCTACTGGCGCACCCTGGTGCTGC
 299    L  L  V  L  L  T  V  F  L  L  L  V  F  Y  T  I  P  G  Q  I
1741 TGCTACTGGTGCTGCTCACCGTCTTCCTCCTCCTGGTCTTCTACACCATCCCTGGCCAGA
 319    S  Q  V  I  F  R  P  L  H  K  *
1801 TCAGCCAGGTCATCTTCCGTCCCCTCCACAAGTGActctcgctgaccttggacactcacc
1861 cagggtgccaacccttcaatgcctgctcctggaagtctttcttacccatgtgagctaccc
1921 cagagtctagtgcttcctctgaataaacctatcacagccacaaaaaaaaaaaaaaaaaaa
1981 aaaaaaaaaaaaaa
```

Figure 2I. The cDNA (SEQ ID NO:18) and amino acid sequence (SEQ ID NO:19) of 158P3D2 v.7.

```
  1 tttttttatgaaacagtctcgctctgtctcccaggttggagtgcagtggcacgatctcgg
 61 ctgactgcaacctccacctcctgggttcaagcgattctcctgcctcagcctccccagtag
121 ctgggattacaggcgtgggccccatgtccagctaattttttatattttcgctctgtctcc
181 caggttggagtgcagtggcacgatctcggctgactgcaacctccacctcctgggttcaag
241 cgattctcctgcctcagcctccccagtagctgggattacaggcgtgggccccatgtcca
301 gctaattttttatattttagtagagacagggtttcaccatgttgtccaggctggtcttga
361 accctgacctcaagtgatccacccacctctgcctcccaaagtgctgggattacaggtgt
421 gagccaccatgccaggcccacttaacctcttcaagtctgttttctcatctgcaaaacaga
481 ggtaataagatcagtatcttcttaatggaagcacctggactacattttttcattcattg
541 ttatcataaatgaggactaacctgtctccgttgggagttttgaacctagacctcatgtc
```

Figure 2I-2

```
601  ttcatgacgtcatcactgccccaggcccagctgtgtccctacaccagccccagctgacgc
661  atcttcttttctgcctgtagagatggttacaatgcctggcgtgatgcattctggccttc
721  gcagatcctggcggggctgtgccaacgctgtggcctccctgccctgaataccgagccgg
781  tgctgtcaaggtgggcagcaaagtcttcctgacaccaccggagaccctgccccagggat
  1           M  W  I  D  I  F  P  Q  D  V  P  A  P  P  P  V  D  I
841  ctcttcacATGTGGATTGACATCTTTCCTCAAGATGTGCCTGCTCCACCCCCAGTTGACA
 19   K  P  R  Q  P  I  S  Y  E  L  R  V  V  I  W  N  T  E  D  V
901  TCAAGCCTCGGCAGCCAATCAGCTATGAGCTCAGAGTTGTCATCTGGAACACGGAGGATG
 39   V  L  D  D  E  N  P  L  T  G  E  M  S  S  D  I  Y  V  K  S
961  TGGTTCTGGATGACGAGAATCCACTCACCGGAGAGATGTCGAGTGACATCTATGTGAAGA
 59   W  V  K  G  L  E  H  D  K  Q  E  T  D  V  H  F  N  S  L  T
1021 GCTGGGTGAAGGGGTTGGAGCATGACAAGCAGGAGACAGACGTTCACTTCAACTCCCTGA
 79   G  E  G  N  F  N  W  R  F  V  F  R  F  D  Y  L  P  T  E  R
1081 CTGGGGAGGGGAACTTCAATTGGCGCTTTGTGTTCCGCTTTGACTACCTGCCCACGGAGC
 99   E  V  S  V  W  R  R  S  G  P  F  A  L  E  E  A  E  F  R  Q
1141 GGGAGGTGAGCGTCTGGCGCAGGTCTGGACCCTTTGCCCTGGAGGAGGCGGAGTTCCGGC
119   P  A  V  L  V  L  Q  V  W  D  Y  D  R  I  S  A  N  D  F  L
1201 AGCCTGCAGTGCTGGTCCTGCAGGTCTGGGACTATGACCGCATCTCTGCCAATGACTTCC
139   G  S  L  E  L  Q  L  P  D  M  V  R  G  A  R  G  P  E  L  C
1261 TTGGATCCCTGGAGTTGCAGCTACCAGACATGGTGCGTGGGGCCCGGGGCCCCGAGCTCT
159   S  V  Q  L  A  R  N  G  A  G  P  R  C  N  L  F  R  C  R  R
1321 GCTCTGTGCAGCTGGCCCGCAATGGGGCCGGGCCGAGGTGCAATCTGTTTCGCTGCCGCC
179   L  R  G  W  W  P  V  V  K  L  K  E  A  E  D  V  E  R  E  A
1381 GCCTGAGGGGCTGGTGGCCGGTAGTGAAGCTGAAGGAGGCAGAGGACGTGGAGCGGGAGG
199   Q  E  A  Q  A  G  K  K  K  R  K  Q  R  R  R  K  G  R  P  E
1441 CGCAGGAGGCTCAGGCTGGCAAGAAGAAGCGAAAGCAGAGGAGGAGGAAGGGCCGGCCAG
219   D  L  E  F  T  D  M  G  G  N  V  Y  I  L  T  G  K  V  E  A
1501 AAGACCTGGAGTTCACAGACATGGGTGGCAATGTGTACATCCTCACGGGCAAGGTGGAGG
239   E  F  E  L  T  V  E  E  A  E  K  R  P  V  G  K  G  R  K
1561 CAGAGTTTGAGCTGCTGACTGTGGAGGAGGCCGAGAAACGGCCAGTGGGGAAGGGCGGA
259   Q  P  E  P  L  E  K  P  S  R  P  K  T  F  N  W  F  V  N
1621 AGCAGCCAGAGCCTCTGGAGAAACCCAGCCGCCCCAAAACTTCCTTCAACTGGTTTGTGA
279   P  L  K  T  F  V  F  F  I  W  R  R  Y  W  R  T  L  V  L  L
1681 ACCCGCTGAAGACCTTTGTCTTCTTCATCTGGCGCCGGTACTGGCGCACCCTGGTGCTGC
299   L  L  V  L  L  T  V  F  L  L  L  V  F  Y  T  I  P  G  Q  I
1741 TGCTACTGGTGCTGCTCACCGTCTTCCTCCTCCTGGTCTTCTACACCATCCCTGGCCAGA
319   S  Q  V  I  F  R  P  L  H  K  *
1801 TCAGCCAGGTCATCTTCCGTCCCCTCCACAAGTGActctcgctgaccttggacactcacc
1861 cagggtgccaacccttcaatgcctgctcctggaagtctttcttacccatgtgagctaccc
```

Figure 2I-3

```
1921 cagagtctagtgcttcctctgaataaacctatcacagccacaaaaaaaaaaaaaaaaaaa
1981 aaaaaaaaaaaaa
```

Figure 2J. The cDNA (SEQ ID NO:20) and amino acid sequence (SEQ ID NO:21) of 158P3D2 v.8.

```
   1 ttttttatgaaacagtctcgctctgtctcccaggttggagtgcagtggcacgatctcgg
  61 ctgactgcaacctccacctcctgggttcaagcgattctcctgcctcagcctcccagtag
 121 ctgggattacaggcgtgggcccatgtccagctaattttatatttttcgctctgtctcc
 181 caggttggagtgcagtggcacgatctcggctgactgcaacctccacctcctgggttcaag
 241 cgattctcctgcctcagcctccccagtagctgggattacaggcgtgggcccccatgtcca
 301 gctaattttatatttttagtagagacagggtttcaccatgttgtccaggctggtcttga
 361 accctgacctcaagtgatccacccacctctgcctcccaaagtgctgggattacaggtgt
 421 gagccaccatgccaggccctcttaacctcttcaagtctgttttctcatctgcaaaacaga
 481 ggtaataagatcagtatcttcttaatggaagcacctggactacattttttttcattcattg
 541 ttatcataaatgaggactaacctgtctcccgttgggagttttgaacctagacctcatgtc
 601 ttcatgacgtcatcactgccccaggcccagctgtgtccctacaccagcccagctgacgc
 661 atcttcttttctgcctgtagagatggttacaatgcctggcgtgatgcattctggccttc
 721 gcagatcctggcggggctgtgccaacgctgtggcctccctgcccctgaataccgagccgg
 781 tgctgtcaaggtgggcagcaaagtcttcctgacaccaccggagaccctgccccagggat
       1       M  W  I  D  I  F  P  Q  D  V  P  A  P  P  P  V  D  I
 841 ctcttcacATGTGGATTGACATCTTTCCTCAAGATGTGCCTGCTCCACCCCCAGTTGACA
      19   K  P  R  Q  P  I  S  Y  E  L  R  V  V  I  W  N  T  E  D  V
 901 TCAAGCCTCGGCAGCCAATCAGCTATGAGCTCAGAGTTGTCATCTGGAACACGGAGGATG
      39   V  L  D  D  E  N  P  L  T  G  E  M  S  S  D  I  Y  V  K  S
 961 TGGTTCTGGACGACGAGAATCCACTCACCGGAGAGATGTCGAGTGACATCTATGTGAAGA
      59   W  V  K  G  L  E  H  D  K  Q  E  T  D  V  H  F  N  S  L  T
1021 GCTGGGTGAAGGGGTTGGAGCATGACAAGCAGGAGACAGACGTTCACTTCAACTCCCTGA
      79   G  E  G  N  F  N  W  R  F  V  F  R  F  D  Y  L  P  T  E  R
1081 CTGGGGAGGGGAACTTCAATTGGCGCTTTGTGTTCCGCTTTGACTACCTGCCCACGGAGC
      99   E  V  S  V  W  R  R  S  G  P  F  A  L  E  E  A  E  F  R  Q
1141 GGGAGGTGAGCGTCTGGCGCAGGTCTGGACCCTTTGCCCTGGAGGAGGCGGAGTTCCGGC
     119   P  A  V  L  V  L  Q  V  W  D  Y  D  R  I  S  A  N  D  F  L
1201 AGCCTGCAGTGCTGGTCCTGCAGGTCTGGGACTATGACCGCATCTCTGCCAATGACTTCC
     139   G  S  L  E  Q  L  P  D  M  V  R  G  A  R  G  P  E  L  C
1261 TTGGATCCCTGGAGTTGCAGCTACCAGACATGGTGCGTGGGGCCCGGGGCCCCGAGCTCT
     159   S  V  Q  L  A  R  N  G  A  G  P  R  C  N  L  F  R  C  R  R
1321 GCTCTGTGCAGCTGGCCCGCAATGGGGCCGGGCCGAGGTGCAATCTGTTTCGCTGCCGCC
```

Figure 2J-2

```
 179      L   R   G   W   W   P   V   V   K   L   E   A   E   D   V   E   R   E   A
1381 GCCTGAGGGGCTGGTGGCCGGTAGTGAAGCTGAAGGAGGCAGAGGACGTGGAGCGGGAGG
 199      Q   E   A   Q   A   G   K   K   K   R   K   Q   R   R   R   K   G   R   P   E
1441 CGCAGGAGGCTCAGGCTGGCAAGAAGAAGCGAAAGCAGAGGAGGAGGAAGGGCCGGCCAG
 219      D   L   E   F   T   D   M   G   G   N   V   Y   I   L   T   G   K   V   E   A
1501 AAGACCTGGAGTTCACAGACATGGGTGGCAATGTGTACATCCTCACGGGCAAGGTGGAGG
 239      E   F   E   L   L   T   V   E   E   A   E   K   R   P   V   G   K   G   R   K
1561 CAGAGTTTGAGCTGCTGACTGTGGAGGAGGCCGAGAAACGGCCAGTGGGGAAGGGCGGA
 259      Q   P   E   P   L   E   K   P   S   R   P   K   T   S   F   N   W   F   V   K
1621 AGCAGCCAGAGCCTCTGGAGAAACCCAGCCGCCCCAAAACTTCCTTCAACTGGTTTGTGA
 279      P   L   K   T   F   V   F   F   I   W   R   R   Y   W   R   T   L   V   L   L
1681 ACCCGCTGAAGACCTTTGTCTTCTTCATCTGGCGCCGGTACTGGCGCACCCTGGTGCTGC
 299      L   L   V   L   L   T   V   F   L   L   L   V   F   Y   T   I   P   G   Q   I
1741 TGCTACTGGTGCTGCTCACCGTCTTCCTCCTCCTGGTCTTCTACACCATCCCTGGCCAGA
 319      S   Q   V   I   F   R   P   L   H   K   *
1801 TCAGCCAGGTCATCTTCCGTCCCCTCCACAAGTGActctcgctgaccttggacactcacc
1861 cagggtgccaacccttcaatgcctgctcctggaagtctttcttacccatgtgagctaccc
1921 cagagtctagtgcttcctctgaataaacctatcacagccacaaaaaaaaaaaaaaaaaaa
1981 aaaaaaaaaaaaaa
```

Figure 2K. The cDNA (SEQ ID NO:22) and amino acid sequence (SEQ ID NO:23) of 158P3D2 v.14.

```
   1 caggtgggcgggctggtgggcagaagggcagacgggcagaggaagtgccagtgccactgg
   1      M   A   L   T   V   S   V   Q   R   L   T   G   L   T   G   T   H   D   R
  61 gaccATGGCTCTGACGGTAAGCGTGCAACGACTAACAGGGCTGACCGGCACCCACGACCG
  20      Q   V   K   L   T   F   R   G   F   T   Q   K   T   R   K   I   H   C   G   P
 121 ACAAGTGAAGCTCACCTTTCGAGGCTTTACCCAGAAAACAAGAAAAATTCACTGTGGTCC
  40      E   A   D   I   G   E   L   F   R   W   P   H   Y   G   A   P   L   A   G   E
 181 AGAAGCAGATATCGGTGAGCTGTTCCGATGGCCCCACTATGGGGCTCCACTGGCTGGGGA
  60      C   L   S   V   Q   V   V   N   C   S   R   V   F   S   L   R   P   L   G   T
 241 GTGTCTGTCTGTGCAGGTGGTCAACTGCAGCCGTGTATTCAGCCTTAGGCCTCTAGGGAC
  80      L   V   I   S   L   Q   Q   L   Q   N   A   G   H   L   V   L   R   E   A   L
 301 CCTGGTGATCTCCCTGCAGCAGCTACAGAATGCTGGGCATTTGGTGCTACGGGAAGCCCT
 100      V   D   E   N   L   Q   V   S   P   I   Q   V   E   L   D   L   K   Y   Q   P
 361 AGTGGATGAGAATCTTCAAGTGTCCCCGATCCAGGTGGAGCTTGACCTGAAGTACCAGCC
 120      P   E   G   A   T   G   A   W   S   E   E   D   F   G   A   P   I   Q   D   S
 421 CCCAGAGGGCGCTACTGGAGCCTGGTCAGAGGAGGACTTTGGGGCACCCATCCAGGACAG
```

Figure 2K-2

```
 140  F   E   L   I   I   P   N   V   G   F   Q   E   L   E   P   G   E   A   Q   L
 481  CTTCGAGTTAATCATCCCCAATGTGGGCTTCCAGGAACTGGAGCCTGGGGAGGCCCAGCT
 160  E   R   R   A   V   A   L   G   R   R   L   A   R   S   L   G   Q   Q   D   D
 541  GGAGCGGCGGGCAGTGGCTCTAGGCCGCAGGCTAGCTCGAAGTCTAGGCCAGCAGGACGA
 180  E   E   N   E   L   E   L   E   Q   D   L   D   D   E   P   D   V   E
 601  TGAAGAGAATGAGCTGGAGCTTGAGCTGGAGCAGGACCTGGATGATGAGCCTGACGTGGA
 200  L   S   G   V   M   F   S   P   L   K   S   R   A   R   A   L   A   H   G   D
 661  ACTTTCTGGTGTTATGTTCAGCCCCCTCAAGAGCCGCGCCAGGGCCCTGGCCCATGGGGA
 220  P   F   Q   V   S   R   A   Q   D   F   Q   V   G   V   T   V   L   E   A   Q
 721  TCCCTTCCAGGTGTCCAGAGCTCAAGACTTCCAGGTGGGAGTCACTGTGCTGGAAGCCCA
 240  K   L   V   G   V   N   I   N   P   Y   V   A   V   Q   V   G   G   Q   R   R
 781  GAAACTGGTGGGAGTCAACATTAACCCCTATGTGGCCGTGCAAGTGGGGGGGCAGCGCCG
 260  V   T   A   T   Q   R   G   T   S   C   P   F   Y   N   E   Y   F   L   F   E
 841  TGTGACCGCCACACAGCGTGGGACCAGTTGCCCCTTCTACAATGAGTACTTCTTGTTCGA
 280  F   H   D   T   R   L   R   L   Q   D   L   L   E   I   T   V   S   G   V
 901  ATTTCATGACACGCGGCTTCGTCTCCAAGACTTGCTGCTGGAGATCACGGTGAGTGGGGT
 300  G   V   T   S   V   L   Q   R   R   G   D   E   K   A   A   G   L   T   P   P
 961  AGGGGTGACCAGTGTCCTTCAGAGAAGGGGGGATGAGAAAGCTGCAGGACTAACACCACC
 320  S   P   K   A   F   H   S   Q   T   L   P   F   M   A   T   R   I   G   T   F
1021  TTCCCCCAAGGCTTTCCATTCGCAGACCCTCCCCTTTATGGCCACCCGGATAGGCACCTT
 340  R   M   D   L   G   I   I   L   D   Q   P   D   G   Q   F   Y   Q   R   W   V
1081  CAGGATGGACCTGGGCATCATCTTGGACCAGCCAGATGGCCAGTTCTACCAAAGATGGGT
 360  P   L   H   D   P   R   D   T   R   A   G   T   K   G   F   I   K   V   T   L
1141  TCCGCTGCATGATCCCCGAGACACCCGCGCCGGGACCAAGGGTTTCATTAAGGTCACCTT
 380  S   V   R   A   R   G   D   L   P   P   P   M   L   P   P   A   P   G   H   C
1201  GTCCGTGAGGGCGCGCGGGACCTGCCCCCTCCAATGCTACCCCCGGCCCCAGGGCACTG
 400  S   D   I   E   K   N   L   L   P   R   G   V   P   A   E   R   P   W   A
1261  TTCGGACATCGAGAAGAACCTGCTCCTGCCGCGCGGGGTGCCCGCCGAGAGGCCATGGGC
 420  R   L   R   V   R   L   Y   R   A   E   G   L   P   A   L   R   L   G   L   L
1321  GCGGCTCCGCGTGCGCCTGTACCGCGCCGAGGGGCTTCCCGCGCTGCGCCTGGGGCTGCT
 440  G   S   L   V   R   A   L   H   D   Q   R   V   L   V   E   P   Y   V   R   V
1381  GGGCAGCCTGGTCCGCGCCCTGCACGACCAGCGCGTCCTGGTGGAGCCCTATGTGCGGGT
 460  S   F   L   G   Q   E   G   E   T   S   V   S   A   E   A   A   P   E   W
1441  GTCTTTCCTGGGGCAGGAGGGCGAGACGTCGGTGAGCGCCGAGGCGGCGGCGCCCGAATG
 480  N   E   Q   L   S   F   V   E   L   F   P   P   L   T   R   S   L   R   L   Q
1501  GAACGAGCAGCTGAGCTTCGTGGAGCTCTTCCCGCCGCTGACGCGCAGCCTCCGCCTGCA
 500  L   R   D   D   A   P   L   V   D   A   A   L   A   T   H   V   P   D   L   R
1561  GCTGCGGGACGACGCGCCCCTGGTCGACGCGGCACTCGCTACGCACGTGCCGGACCTGAG
 520  R   I   S   H   P   G   R   A   A   G   F   N   P   T   F   G   P   A   W   V
```

Figure 2K-3

```
1621 GCGGATCTCCCATCCGGGCCGCGCGGCGGGGTTTAACCCTACCTTCGGCCCGGCCTGGGT
 540   P  L  Y  G  S  P  P  G  A  G  L  R  D  S  L  Q  G  L  N  E
1681 GCCCCTCTATGGCTCGCCCCCCGGCGCGGGGCTCCGGGATAGTCTTCAAGGTCTCAACGA
 560   G  V  G  Q  G  I  W  F  R  G  R  L  L  A  V  S  M  Q  V
1741 AGGCGTTGGCCAAGGCATTTGGTTCCGCGGCCGCCTTCTGCTGGCTGTGTCCATGCAGGT
 580   L  E  G  R  A  E  P  E  P  P  Q  A  Q  Q  G  S  T  L  S  R
1801 GTTGGAAGGGAGAGCTGAACCTGAGCCTCCCCAGGCCCAGCAGGGGTCCACGTTGTCCCG
 600   L  T  R  K  K  K  K  A  R  R  D  Q  T  P  K  A  V  P  Q
1861 GCTCACCCGAAAGAAGAAAAAGAAAGCCAGAAGGGATCAGACCCCAAAGGCGGTTCCGCA
 620   H  L  D  A  S  P  G  A  E  G  P  E  I  P  R  A  M  E  V  E
1921 GCACTTGGACGCCAGCCCCGGTGCCGAGGGGCCTGAGATCCCCGTGCCATGGAGGTGGA
 640   V  E  E  L  L  P  L  P  E  N  V  L  A  P  C  E  D  F  L  L
1981 GGTGGAGGAGCTGCTGCCGCTGCCAGAGAATGTCCTGGCGCCCTGTGAAGATTTCCTGCT
 660   F  G  V  L  F  E  A  T  M  I  D  P  T  V  A  S  Q  P  I  S
2041 TTTCGGTGTGCTCTTCGAGGCCACCATGATCGACCCCACCGTGGCCTCCCAGCCCATCAG
 680   F  E  I  S  I  G  R  A  G  R  L  E  E  Q  L  G  R  G  S  R
2101 CTTCGAGATCTCCATTGGTCGCGCAGGCCGTCTGGAGGAGCAATTGGGCCGAGGGTCCAG
 700   A  G  E  G  T  E  G  A  A  V  E  A  Q  P  L  L  G  A  R  P
2161 GGCTGGGGAGGGAACTGAGGGTGCAGCCGTGGAGGCTCAGCCTCTGCTGGGAGCCAGGCC
 720   E  E  E  K  E  E  E  E  L  G  T  H  A  Q  R  P  E  P  M  D
2221 AGAGGAGGAGAAAGAGGAGGAAGAACTGGGGACCCATGCTCAGCGGCCTGAGCCCATGGA
 740   G  S  G  P  Y  F  C  L  P  L  C  H  C  K  P  C  M  H  V  W
2281 CGGCAGTGGGCCATACTTCTGCTTGCCCCTCTGTCACTGCAAGCCATGCATGCATGTGTG
 760   S  C  W  E  D  H  T  W  R  L  Q  S  S  N  C  V  R  K  V  A
2341 GAGTTGCTGGGAGGACCACACCTGGCGCCTGCAGAGCAGCAACTGCGTGCGCAAAGTGGC
 780   E  R  L  D  Q  C  L  Q  E  V  E  R  L  Q  R  K  P  C  P  C
2401 CGAGAGGCTGGACCAGGGGCTGCAGGAGGTTGAGAGACTGCAGCGCAAGCCGGGGCCTGG
 800   A  C  A  Q  L  K  Q  A  L  E  V  L  V  A  G  S  R  Q  F  C
2461 CGCCTGTGCACAGCTCAAGCAGGCACTGGAAGTACTGGTGGCTGGGAGCAGACAGTTTTG
 820   H  G  A  E  R  R  T  M  T  R  P  N  A  L  D  R  C  R  G  K
2521 CCACGGTGCCGAGCGCAGGACGATGACCCGGCCCAATGCCCTGGATCGATGCCGAGGGAA
 840   L  L  V  H  S  L  N  L  L  A  K  Q  G  L  R  L  L  R  G  L
2581 ACTCCTGGTGCACAGCCTGAACCTTTTGGCTAAGCAAGGACTGCGACTTCTACGCGGCCT
 860   R  R  R  N  V  Q  K  K  V  A  L  A  K  K  L  L  A  K  L  R
2641 GAGACGGCGCAATGTGCAAAAGAAGGTGGCACTGGCCAAGAAGCTCCTGGCAAAACTGCG
 880   F  L  A  E  E  P  Q  P  P  L  P  D  V  L  V  W  M  L  S  G
2701 CTTTCTGGCTGAGGAGCCCCAGCCACCCCTCCCCGATGTGCTGGTCTGGATGCTCAGCGG
 900   Q  R  R  V  A  W  A  R  I  P  A  Q  D  V  L  F  S  V  V  E
2761 GCAGCGCCGTGTGGCCTGGGCCCGGATCCCTGCCCAGGATGTGCTGTTCTCTGTGGTTGA
```

Figure 2K-4

```
 920  E  E  R  G  R  D  C  G  K  I  Q  S  L  M  L  T  A  P  G  A
2821  GGAGGAACGGGGCCGAGACTGTGGGAAGATCCAGAGTCTAATGCTCACGGCACCCGGGGC
 940  A  P  G  E  V  C  A  K  L  E  L  F  L  R  L  G  L  G  K  Q
2881  AGCCCCTGGTGAGGTCTGTGCCAAGCTGGAGCTCTTCCTGCGGCTGGGCCTGGGCAAGCA
 960  A  K  A  C  T  S  E  L  P  P  D  L  L  P  E  P  S  A  G  L
2941  AGCCAAGGCCTGCACCTCTGAGCTGCCCCCGGATTTGCTGCCCGAGCCCTCAGCCGGGCT
 980  P  S  S  L  H  R  D  D  F  S  Y  F  Q  L  R  A  H  L  Y  Q
3001  GCCCTCCAGCCTACACCGGGACGACTTTAGCTACTTCCAACTCCGGGCTCACTTGTACCA
1000  A  R  G  V  L  A  A  D  D  S  G  L  S  D  P  F  A  R  V  L
3061  GGCCCGGGGTGTGTTGGCTGCAGATGACAGTGGCCTCTCGGACCCCTTTGCTCGAGTCCT
1020  I  S  T  Q  C  Q  T  T  R  V  L  E  Q  T  L  S  P  L  W  D
3121  CATCTCTACCCAGTGTCAGACCACACGGGTCCTGGAGCAGACGCTGAGCCCTCTGTGGGA
1040  E  L  L  V  F  E  Q  L  I  V  D  G  R  R  E  H  L  Q  E  E
3181  TGAACTCCTGGTATTTGAGCAGTTGATCGTGGATGGGAGGAGGGAGCACCTGCAGGAGGA
1060  P  P  L  V  I  I  N  V  F  D  H  N  K  F  G  P  P  V  F  L
3241  GCCTCCATTAGTGATCATCAATGTATTTGACCACAATAAGTTTGGCCCCCCCGTGTTCCT
1080  G  R  A  L  A  A  P  R  V  K  L  M  E  D  P  Y  Q  R  P  E
3301  GGGCAGGGCACTGGCCGCCCCAAGGGTAAAGCTGATGGAGGACCCATACCAACGCCCAGA
1100  L  Q  F  F  P  L  R  K  G  P  W  A  A  G  E  L  I  A  A  F
3361  GTTGCAGTTCTTCCCCCTGAGGAAGGGACCCTGGGCAGCCGGAGAGCTCATTGCCGCCTT
1120  Q  L  I  E  L  D  Y  S  G  R  L  E  P  S  V  P  S  E  V  E
3421  TCAACTCATTGAACTAGACTACAGTGGCCGACTTGAGCCCTCAGTGCCCAGTGAGGTGGA
1140  P  Q  D  L  A  P  L  V  E  P  H  S  G  R  L  S  L  P  P  N
3481  GCCCCAGGATCTGGCACCCCTGGTTGAGCCCCACTCTGGACGCCTGTCCCTTCCACCCAA
1160  V  C  P  V  L  R  E  F  R  V  E  V  L  F  W  G  L  R  G  L
3541  CGTGTGCCCAGTGCTCAGGGAGTTCCGTGTTGAGGTGCTGTTCTGGGGTCTTAGGGGACT
1180  G  R  V  H  L  L  E  V  E  Q  P  Q  V  V  L  E  V  A  G  Q
3601  TGGTCGTGTGCATCTGCTCGAGGTGGAGCAGCCCCAGGTTGTACTGGAGGTGGCTGGGCA
1200  G  V  E  S  E  V  L  A  S  Y  R  E  S  P  N  F  T  E  L  V
3661  AGGTGTGGAGTCTGAGGTCCTGGCCAGCTACCGTGAGAGCCCCAATTTCACTGAGCTTGT
1220  R  H  L  T  V  D  L  P  E  Q  P  Y  L  Q  P  P  L  S  I  L
3721  CAGGCATCTGACAGTGGACTTGCCGGAGCAGCCTTACTTGCAGCCTCCACTCAGCATCTT
1240  V  I  E  R  R  A  F  G  H  T  V  L  V  G  S  H  I  V  P  H
3781  GGTGATTGAGCGCCGGGCCTTTGGCCACACAGTCCTTGTGGGTTCCCACATTGTCCCCCA
1260  M  L  R  F  T  F  R  G  H  E  D  P  P  E  E  E  G  E  M  E
3841  CATGCTGCGATTCACATTTCGGGGTCATGAGGATCCTCCTGAGGAGGAAGGAGAGATGGA
1280  E  T  G  D  M  M  P  K  G  P  Q  G  Q  K  S  L  D  P  F  L
3901  GGAGACAGGGGATATGATGCCCAAGGGACCTCAAGGACAGAAGTCCCTGGATCCCTTCTT
1300  A  E  A  G  I  S  R  Q  L  L  K  P  P  L  K  K  L  P  L  G
```

Figure 2K-5

```
3961 GGCTGAAGCGGGTATATCCAGACAGCTCCTGAAGCCTCCTCTGAAGAAGCTCCCACTAGG
1320   G   L   L   N   Q   G   P   G   L   E   E   D   I   P   D   P   E   E   L   D
4021 AGGCCTCCTAAATCAAGGCCCTGGGCTGGAGGAAGACATCCCAGATCCAGAGGAGCTCGA
1340   W   G   S   K   Y   Y   A   S   L   Q   E   L   Q   G   Q   H   N   F   D   E
4081 CTGGGGGTCCAAGTACTATGCGTCGCTGCAGGAGCTCCAGGGGCAGCACAACTTTGATGA
1360   D   E   M   D   D   P   G   D   S   D   G   V   N   L   I   S   M   V   G   E
4141 AGATGAAATGGATGATCCTGGAGATTCAGATGGGGTCAACCTCATTTCTATGGTTGGGGA
1380   T   Q   D   Q   D   L   Q   Q   V   P   F   G   R   T   *
4201 GATCCAAGACCAGGATCTACAACAGGTCCCTGAAGGAAGAATTTAAccactttgaagact
4261 ggctgaatgtgtttcctctgtaccgagggcaaggggccaggatggaggtggagaagagg
4321 aaggatctggacaccttgtgggcaagttcaagggctccttcctcatttaccctgaatcag
4381 aggcagtgttgttctctgagccccagatctcccgggggatcccacagaaccggcccatca
4441 agctcctggtcagagtgtatgttgtaaaggctaccaacctggctcctgcagaccccaatg
4501 gcaaagcagaccctttacgtggtggtgagcgctggccgggagcggcaggacaccaaggaac
4561 gctacatccccaagcagctcaaccccatctttggagagatcctggagctaagcatctctc
4621 tcccagctgagacggagctgacggtcgccgtatttgatcatgacctcgtgggttctgacg
4681 acctcatcggggagacccacattgatctggaaaaccgattctatagccaccacagagcaa
4741 actgtgggctggcctcccagtatgaagtgtgggtccagcagggcccacaggagccattct
4801 gagtttctggccaaacacattcaagctcacattcccttttgtgtctccagatcctatgat
4861 ttcatggaaggggacccctcccacccaccgccactgccaaccaagacatagctcagtggtc
4921 aagacttgggcttgggagtcgggatcctgtaacgaatgtcacttgaccgctttcttttttt
4981 tatgaaacagtctcgctctgtctcccaggttggagtgcagtggcacgatctcggctgact
5041 gcaacctccacctcctgggttcaagcgattctcctgcctcagcctccccagtagctggga
5101 ttacaggcgtgggcccccatgtccagctaattttttatattttcgctctgtctcccaggtt
5161 ggagtgcagtggcacgatctcggctgactgcaacctccacctcctgggttcaagcgattc
5221 tcctgcctcagcctccccagtagctgggattacaggcgtgggcccccatgtccagctaat
5281 tttatattttagtagagacagggtttcaccatgttgtccaggctggtcttgaacccct
5341 gacctcaagtgatccaccacctctgcctcccaaagtgctgggattacaggtgtgagcca
5401 ccatgccaggccctcttaacctcttcaagtctgttttctcatctgcaaaacagaggtaat
5461 aagatcagtatcttcttaatggaagcacctggactacatttttttcattcattgttatca
5521 taaatgaggactaacctgtctcccgttgggagttttgaacctagacctcatgtcttcatg
5581 acgtcatcactgccccaggcccagctgtgtccctacaccagccccagctgacgcatcttc
5641 tttttctgcctgtagagatggttacaatgcctggcgtgatgcattctggccttcgcagat
5701 cctggcggggctgtgccaacgctgtggcctccctgcccctgaataccgagccggtgctgt
5761 caaggtgggcagcaaagtcttcctgacaccaccggagaccctgccccagggatctcttc
5821 acatgtggattgacatctttcctcaagatgtgcctgctccaccccagttgacatcaagc
5881 ctcggcagccaatcagctatgagctcagagttgtcatctggaacacggaggatgtggttc
5941 tggatgacgagaatccactcaccggagagatgtcgagtgacatctatgtgaagaggtagg
6001 ctgctggccgggcggggcaacggcggtgcactaggggattgcaaatgggtgtgggccct
```

Figure 2K-6

```
6061 cgggctgagtccagagccccgaccccaggccctccgtggtgctgagagcggggtgaggag
6121 tgggttctccatgtagctccagccctgacgctcacccaccccggccccagctgggtgaag
6181 gggttggagcatgacaagcaggagacagacgttcacttcaactccctgactggggagggg
6241 aacttcaattggcgctttgtgttccgctttgactacctgcccacggagcgggaggtgagc
6301 gtctggcgcaggtctggaccctttgccctggaggaggcggagttccggcagcctgcagtg
6361 ctggtcctgcaggtctgggactatgaccgcatctctgccaatgacttccttggatccctg
6421 gagttgcagctaccagacatggtgcgtggggcccggggccccgagctctgctctgtgcag
6481 ctggcccgcaatggggccgggccgaggtgcaatctgtttcgctgccgccgcctgaggggc
6541 tggtggccggtagtgaagctgaaggaggcagaggacgtggagcgggaggcgcaggaggct
6601 caggctggcaagaagaagcgaaagcagaggaggaggaagggccggccagaagacctggag
6661 ttcacagacatgggtggcaatgtgtacatcctcacgggcaaggtggaggcagagtttgag
6721 ctgctgactgtggaggaggccgagaaacggccagtggggaaggggcggaagcagccagag
6781 cctctggagaaacccagccgcccccaaaacttccttcaactggtttgtgaacccgctgaag
6841 acctttgtcttcttcatctggcgccggtactggcgcaccctggtgctgctgctactggtg
6901 ctgctcaccgtcttcctcctcctggtcttctacaccatccctggccagatcagccaggtc
6961 atcttccgtccctccacaagtgactctcgctgaccttggacactcacccagggtgccaa
7021 cccttcaatgcctgctcctggaagtctttcttacccatgtgagctaccccagagtctagt
7081 gcttcctctgaataaacctatcacagcc
```

Figure 2L. The cDNA (SEQ ID NO:24) and amino acid sequence (SEQ ID NO:25) of 158P3D2 v.15.

```
  1 caggtgggcgggctggtgggcagaagggcagacgggcagaggaagtgccagtgccactgg
  1     M  A  L  T  V  S  V  Q  R  L  T  G  L  T  G  T  H  D  R
 61 gaccATGGCTCTGACGGTAAGCGTGCAACGACTAACAGGGCTGACCGGCACCCACGACCG
 20  Q  V  K  L  T  F  R  G  F  T  Q  K  T  R  K  I  H  C  G  P
121 ACAAGTGAAGCTCACCTTTCGAGGCTTTACCCAGAAAACAAGAAAAATTCACTGTGGTCC
 40  E  A  D  I  G  E  L  F  R  W  P  H  Y  G  A  P  L  A  G  E
181 AGAAGCAGATATCGGTGAGCTGTTCCGATGGCCCCACTATGGGGCTCCACTGGCTGGGGA
 60  C  L  S  V  Q  V  V  N  C  S  R  V  F  S  L  R  P  L  G  T
241 GTGTCTGTCTGTGCAGGTGGTCAACTGCAGCCGTGTATTCAGCCTTAGGCCTCTAGGGAC
 80  L  V  I  S  L  Q  Q  L  Q  N  A  G  H  L  V  L  R  E  A  L
301 CCTGGTGATCTCCCTGCAGCAGCTACAGAATGCTGGGCATTTGGTGCTACGGGAAGCCCT
100  V  D  E  N  L  Q  V  S  P  I  Q  V  E  L  D  L  K  Y  Q  P
361 AGTGGATGAGAATCTTCAAGTGTCCCCGATCCAGGTGGAGCTTGACCTGAAGTACCAGCC
120  P  E  G  A  T  G  A  W  S  E  E  D  F  G  A  P  I  Q  D  S
421 CCCAGAGGGCGCTACTGGAGCCTGGTCAGAGGAGGACTTTGGGGCACCCATCCAGGACAG
140  F  E  L  I  I  P  N  V  G  F  Q  E  L  E  P  G  E  A  Q  L
```

Figure 2L-2

```
 481 CTTCGAGTTAATCATCCCCAATGTGGGCTTCCAGGAACTGGAGCCTGGGGAGGCCCAGCT
 160   E  R  R  A  V  A  L  G  R  R  L  A  R  S  L  G  Q  Q  D  D
 541 GGAGCGGCGGGCAGTGGCTCTAGGCCGCAGGCTAGCTCGAAGTCTAGGCCAGCAGGACGA
 180   E  E  N  E  L  E  L  E  L  E  Q  D  L  D  D  E  P  D  V  E
 601 TGAAGAGAATGAGCTGGAGCTTGAGCTGGAGCAGGACCTGGATGATGAGCCTGACGTGGA
 200   L  S  G  V  M  F  S  P  L  K  S  R  A  R  A  L  A  H  G  D
 661 ACTTTCTGGTGTTATGTTCAGCCCCCTCAAGAGCCGCGCCAGGGCCCTGGCCCATGGGGA
 220   P  F  Q  V  S  R  A  Q  D  F  Q  V  G  V  T  V  L  E  A  Q
 721 TCCCTTCCAGGTGTCCAGAGCTCAAGACTTCCAGGTGGGAGTCACTGTGCTGGAAGCCCA
 240   K  L  V  G  V  N  I  N  P  Y  V  A  V  Q  V  G  G  Q  R  R
 781 GAAACTGGTGGGAGTCAACATTAACCCCTATGTGGCCGTGCAAGTGGGGGGCAGCGCCG
 260   V  T  A  T  Q  R  G  T  S  C  P  F  Y  N  E  Y  L  F  E
 841 TGTGACCGCCACACAGCGTGGGACCAGTTGCCCCTTCTACAATGAGTACTTCTTGTTCGA
 280   F  H  D  T  R  L  R  L  Q  D  L  L  L  E  I  T  V  S  G  V
 901 ATTTCATGACACGCGGCTTCGTCTCCAAGACTTGCTGCTGGAGATCACGGTGAGTGGGGT
 300   G  V  T  S  V  L  Q  R  R  G  D  E  K  A  A  G  L  T  P  P
 961 AGGGGTGACCAGTGTCCTTCAGAGAAGGGGGGATGAGAAAGCTGCAGGACTAACACCACC
 320   S  P  K  A  F  H  S  Q  T  L  P  F  M  A  T  R  I  G  T  F
1021 TTCCCCCAAGGCTTTCCATTCGCAGACCCTCCCCTTTATGGCCACCCGGATAGGCACCTT
 340   R  M  D  L  G  I  I  L  D  Q  P  D  G  Q  F  Y  Q  R  W  V
1081 CAGGATGGACCTGGGCATCATCTTGGACCAGCCAGATGGCCAGTTCTACCAAAGATGGGT
 360   P  L  H  D  P  R  D  T  R  A  G  T  K  G  F  I  K  V  T  L
1141 TCCGCTGCATGATCCCCGAGACACCCGCGCCGGGACCAAGGGTTTCATTAAGGTCACCTT
 380   S  V  R  A  R  G  D  L  P  P  P  M  L  P  P  A  P  G  H  C
1201 GTCCGTGAGGGCGCGCGGGGACCTGCCCCCTCCAATGCTACCCCCGGCCCCAGGGCACTG
 400   S  D  I  E  K  N  L  L  P  R  G  V  P  A  E  R  P  W  A
1261 TTCGGACATCGAGAAGAACCTGCTCCTGCCGCGCGGGGTGCCCGCCGAGAGGCCATGGGC
 420   R  L  R  V  R  L  Y  R  A  E  G  L  P  A  L  R  L  G  L  L
1321 GCGGCTCCGCGTGCGCCTGTACCGCGCCGAGGGGCTTCCCGCGCTGCGCCTGGGGCTGCT
 440   G  S  L  V  R  A  L  H  D  Q  R  V  L  V  E  P  Y  V  R  V
1381 GGGCAGCCTGGTCCGCGCCCTGCACGACCAGCGCGTCCTGGTGGAGCCCTATGTGCGGGT
 460   S  F  L  G  Q  E  G  E  T  S  V  S  A  E  A  A  A  P  E  W
1441 GTCTTTCCTGGGGCAGGAGGGCGAGACGTCGGTGAGCGCCGAGGCGGCGGCGCCCGAATG
 480   N  E  Q  L  S  F  V  E  L  F  P  P  L  T  R  S  L  R  L  Q
1501 GAACGAGCAGCTGAGCTTCGTGGAGCTCTTCCCGCCGCTGACGCGCAGCCTCCGCCTGCA
 500   L  R  D  D  A  P  L  V  D  A  A  L  A  T  H  V  P  D  L  R
1561 GCTGCGGGACGACGCGCCCCTGGTCGACGCGGCACTCGCTACGCACGTGCCGGACCTGAG
 520   R  I  S  H  P  G  R  A  A  G  F  N  P  T  F  G  P  A  W  V
1621 GCGGATCTCCCATCCGGGCCGCGCGGCGGGGTTTAACCCTACCTTCGGCCCCGGCCTGGGT
```

Figure 2L-3

```
 540  P  L  Y  G  S  P  P  G  A  G  L  R  D  S  L  Q  G  L  N  E
1681  GCCCCTCTATGGCTCGCCCCCGGCGCGGGGCTCCGGGATAGTCTTCAAGGTCTCAACGA
 560  G  V  G  Q  G  I  W  F  R  G  R  L  L  A  V  S  M  Q  V
1741  AGGCGTTGGCCAAGGCATTTGGTTCCGCGGCCGCCTTCTGCTGGCTGTGTCCATGCAGGT
 580  L  E  G  R  A  E  P  E  P  P  Q  A  Q  Q  G  S  T  L  S  R
1801  GTTGGAAGGGAGAGCTGAACCTGAGCCTCCCCAGGCCCAGCAGGGGTCCACGTTGTCCCG
 600  L  T  R  K  K  K  K  A  R  R  D  Q  T  P  K  A  V  P  Q
1861  GCTCACCCGAAAGAAGAAAAAGAAAGCCACAAGGGATCAGACCCCAAAGGCGGTTCCGCA
 620  H  L  D  A  S  P  G  A  E  G  P  E  I  P  R  A  M  E  V  E
1921  GCACTTGGACGCCAGCCCCGGTGCCGAGGGGCCTGAGATCCCCGTGCCATGGAGGTGGA
 640  V  E  E  L  L  P  L  P  E  N  V  L  A  P  C  E  D  F  L  L
1981  GGTGGAGGAGCTGCTGCCGCTGCCAGAGAATGTCCTGGCGCCCTGTGAAGATTTCCTGCT
 660  F  G  V  L  F  E  A  T  M  I  D  P  T  V  A  S  Q  P  I  S
2041  TTTCGGTGTGCTCTTCGAGGCCACCATGATCGACCCCACCGTGGCCTCCCAGCCCATCAG
 680  F  E  I  S  I  G  R  A  G  R  L  E  E  Q  L  G  R  G  S  R
2101  CTTCGAGATCTCCATTGGTCGCGCAGGCCGTCTGGAGGAGCAATTGGGCCGAGGGTCCAG
 700  A  G  E  G  T  E  G  A  A  V  E  A  Q  P  L  L  G  A  R  P
2161  GGCTGGGGAGGGAACTGAGGGTGCAGCCGTGGAGGCTCAGCCTCTGCTGGGAGCCAGGCC
 720  E  E  E  K  E  E  E  E  L  G  T  H  A  Q  R  P  E  P  M  D
2221  AGAGGAGGAGAAAGAGGAGGAAGAACTGGGGACCCATGCTCAGCGGCCTGAGCCCATGGA
 740  G  S  G  P  Y  F  C  L  P  L  C  H  C  K  P  C  M  H  V  W
2281  CGGCAGTGGGCCATACTTCTGCTTGCCCCTCTGTCACTGCAAGCCATGCATGCATGTGTG
 760  S  C  W  E  D  H  T  W  R  L  Q  S  S  N  C  V  R  K  V  A
2341  GAGTTGCTGGGAGGACCACACCTGGCGCCTGCAGAGCAGCAACTGCGTGCGCAAAGTGGC
 780  E  R  L  D  Q  G  L  Q  E  V  E  R  L  Q  R  K  P  G  P  G
2401  CGAGAGGCTGGACCAGGGGCTGCAGGAGGTTGAGAGACTGCAGCGCAAGCCGGGGCCTGG
 800  A  C  A  Q  L  K  Q  A  L  E  V  L  V  A  G  S  R  Q  F  C
2461  CGCCTGTGCACAGCTCAAGCAGGCACTGGAAGTACTGGTGGCTGGGAGCAGACAGTTTTG
 820  H  G  A  E  R  R  T  M  T  R  P  N  A  L  D  R  C  R  G  K
2521  CCACGGTGCCGAGCGCAGGACGATGACCCGGCCCAATGCCCTGGATCGATGCCGAGGGAA
 840  L  L  V  H  S  L  N  L  L  A  K  Q  G  L  R  L  L  R  G  L
2581  ACTCCTGGTGCACAGCCTGAACCTTTTGGCTAAGCAAGGACTGCGACTTCTACGCGGCCT
 860  R  R  R  N  V  Q  K  K  V  A  L  A  K  K  L  L  A  K  L  R
2641  GAGACGGCGCAATGTGCAAAAGAAGGTGGCACTGGCCAAGAAGCTCCTGGCAAAACTGCG
 880  F  L  A  E  E  H  N  F  D  E  D  E  M  D  D  P  G  D  S  D
2701  CTTTCTGGCTGAGGAGCACAACTTTGATGAAGATGAAATGGATGATCCTGGAGATTCAGA
 900  G  V  N  L  I  S  M  V  G  E  I  Q  D  Q  G  E  A  E  V  K
2761  TGGGGTCAACCTCATTTCTATGGTTGGGGAGATCCAAGACCAGGGTGAGGCTGAAGTCAA
 920  G  T  V  S  P  K  K  A  V  A  T  L  K  I  Y  N  R  S  L  K
```

Figure 2L-4

```
2821 AGGCACTGTGTCCCCAAAAAAAGCAGTTGCCACCCTGAAGATCTACAACAGGTCCCTGAA
 940   E  E  F  N  H  F  E  D  W  L  N  V  F  P  L  Y  R  G  Q  G
2881 GGAAGAATTTAACCACTTTGAAGACTGGCTGAATGTGTTTCCTCTGTACCGAGGGCAAGG
 960   G  Q  D  G  G  E  E  G  S  G  H  L  V  G  K  F  K  G
2941 GGGCCAGGATGGAGGTGGAGAAGAGGAAGGATCTGGACACCTTGTGGGCAAGTTCAAGGG
 980   S  F  L  I  Y  P  E  S  A  V  L  F  S  E  P  Q  I  S  R
3001 CTCCTTCCTCATTTACCCTGAATCAGAGGCAGTGTTGTTCTCTGAGCCCCAGATCTCCCG
1000   G  I  P  Q  N  R  P  I  K  L  L  V  R  V  Y  V  V  K  L  R
3061 GGGGATCCCACAGAACCGGCCCATCAAGCTCCTGGTCAGAGTGTATGTTGTAAAGCTAAG
1020   N  L  C  K  I  Q  G  H  E  D  F  C  L  F  S  A  A  T  N  L
3121 AAACCTTTGCAAAATCCAAGGTCATGAAGACTTTTGCCTGTTTTCTGCTGCTACCAACCT
1040   A  P  A  D  P  N  G  K  A  D  P  Y  V  V  V  S  A  G  R  E
3181 GGCTCCTGCAGACCCCAATGGCAAAGCAGACCCTTACGTGGTGGTGAGCGCTGGCCGGGA
1060   R  Q  D  T  K  E  R  Y  I  P  K  Q  L  N  P  I  F  G  E  I
3241 GCGGCAGGACACCAAGGAACGCTACATCCCCAAGCAGCTCAACCCCATCTTTGGAGAGAT
1080   L  E  L  S  I  S  L  P  A  E  T  E  L  T  V  A  V  F  D  H
3301 CCTGGAGCTAAGCATCTCTCTCCCAGCTGAGACGGAGCTGACGGTCGCCGTATTTGATCA
1100   D  L  V  G  S  D  D  L  I  G  E  T  H  I  D  L  E  N  R  F
3361 TGACCTCGTGGGTTCTGACGACCTCATCGGGGAGACCCACATTGATCTGGAAAACCGATT
1120   Y  S  H  H  R  A  N  C  G  L  A  S  Q  Y  E  V  W  V  Q  Q
3421 CTATAGCCACCACAGAGCAAACTGTGGGCTGGCCTCCCAGTATGAAGTGTGGGTCCAGCA
1140   G  P  Q  E  P  F  *
3481 GGGCCCACAGGAGCCATTCTGAgtttctggccaaacacattcaagctcacattcccttt
3541 gtgtctccagatcctatgatttcatggaaggggaccctcccaccaccgccactgccaac
3601 caagacatagctcagtggtcaagacttgggcttgggagtcgggatcctgtaacgaatgtc
3661 acttgaccgctttctttttttatgaaacagtctcgctctgtctcccaggttggagtgcag
3721 tggcacgatctcggctgactgcaacctccacctcctgggttcaagcgattctcctgcctc
3781 agcctccccagtagctgggattacaggcgtgggccccatgtccagctaatttttatatt
3841 ttcgtctgtctcccaggttggagtgcagtggcacgatctcggctgactgcaacctccac
3901 ctcctgggttcaagcgattctcctgcctcagcctccccagtagctgggattacaggcgtg
3961 ggccccatgtccagctaattttatattttagtagagacagggtttcaccatgttgtc
4021 caggctggtcttgaacccctgacctcaagtgatccacccacctctgcctcccaaagtgct
4081 gggattacaggtgtgagccaccatgccaggccctcttaacctcttcaagtctgttttctc
4141 atctgcaaaacagaggtaataagatcagtatcttcttaatggaagcacctggactacatt
4201 ttttcattcattgttatcataaatgaggactaacctgtctcccgttgggagttttgaac
4261 ctagacctcatgtcttcatgacgtcatcactgccccagggcccagctgtgtccctacacca
4321 gccccagctgacgcatcttcttttctgcctgtagagatggttacaatgcctggcgtgat
4381 gcattctggccttcgcagatcctggcggggctgtgccaacgctgtggcctccctgccct
4441 gaataccgagccggtgctgtcaaggtgggcagcaaagtcttcctgacaccaccggagacc
```

Figure 2L-5

```
4501 ctgcccccagggatctcttcacatgtggattgacatctttcctcaagatgtgcctgctcc
4561 accccccagttgacatcaagcctcggcagccaatcagctatgagctcagagttgtcatctg
4621 gaacacggaggatgtggttctggatgacgagaatccactcaccggagagatgtcgagtga
4681 catctatgtgaagaggtaggctgctggccgggcggggcaacggcggtgcactagggggat
4741 tgcaaatgggtgtgggccctcgggctgagtccagagcccgaccccaggccctccgtggt
4801 gctgagagcggggtgaggagtggggttctccatgtagctccagccctgacgctcacccacc
4861 ccggccccagctgggtgaaggggttggagcatgacaagcaggagacagacgttcacttca
4921 actccctgactggggaggggaacttcaattggcgctttgtgttccgctttgactacctgc
4981 ccacggagcgggaggtgagcgtctggcgcaggtctggaccctttgccctggaggaggcgg
5041 agttccggcagcctgcagtgctggtcctgcaggtctgggactatgaccgcatctctgcca
5101 atgacttccttggtattacaatgcttagccttcccacccctcagccctgcctccagccc
5161 tcacctccgcccctgcctccagccctcacttccgtccccagttccctactctgacccaa
5221 ccttgaatcttgggattttggacccgaggtgtgaaacctttgctttctggcctaattact
5281 gagttaattaggcctagaccacagtaacctccattcccacccagagtctctgattcaact
5341 ctgatttgaccctagcttgtcaccctgacaccgactccacagcctttggtccttggcact
5401 ctgatcccgaccttggccctcttccactgggaagtagcaatgggtggaccgctgggctg
5461 tggtctggtggtctatagctgtggcctgaccgcacactgcaacaactttcaatgcccca
5521 atttacaaccttggtgtgttgcctcctcacccctggcacaatgagactttgatcccatgc
5581 ctaatctggtgtgctctggacttgcaggatccctggagttgcagctaccagacatggtgc
5641 gtggggcccggggccccgagctctgctctgtgcagctggccgcaatggggccgggccga
5701 ggtgcaatctgtttcgctgccgcgcctgaggggctggtggccggtagtgaagctgaagg
5761 agcagaggacgtggagcgggaggcgcaggaggctcaggctggcaagaagaagcgaaagc
5821 agaggaggaggaagggccggccagaagacctggagttcacagacatgggtggcaatgtgt
5881 acatcctcacgggcaaggtggaggcagagtttgagctgctgactgtggaggaggccgaga
5941 acggccagtggggaaggggcggaagcagccagagcctctggagaaacccagccgcccca
6001 aaacttccttcaactggttgtgaacccgctgaagacctttgtcttcttcatctggcgcc
6061 ggtactggcgcaccctggtgctgctgctactggtgctgctcaccgtcttcctcctcctgg
6121 tcttctacaccatccctggccagatcagccaggtcatcttccgtcccctccacaagtgac
6181 tctcgctgaccttggacactcacccagggtgccaaccttcaatgcctgctcctggaagt
6241 ctttcttacccatgtgagctaccccagagtctagtgcttcctctgaataaacctatcaca
6301 gcc
```

Figure 2M. The cDNA (SEQ ID NO:26) and amino acid sequence (SEQ ID NO:27) of 158P3D2 v.16.

```
  1 caggtgggcgggctggtgggcagaagggcagacgggcagaggaagtgccagtgccactgg
  1      M  A  L  T  V  S  V  Q  R  L  T  G  L  T  G  T  H  D  R
 61 gaccATGGCTCTGACGGTAAGCGTGCAACGACTAACAGGGCTGACCGGCACCCACGACCG
```

Figure 2M-2

```
  20  Q  V  K  L  T  F  R  G  F  T  Q  K  T  R  K  I  H  C  G  P
 121  ACAAGTGAAGCTCACCTTTCGAGGCTTTACCCAGAAAACAAGAAAAATTCACTGTGGTCC
  40  E  A  D  I  G  E  L  F  R  W  P  H  Y  G  A  P  L  A  G  E
 181  AGAAGCAGATATCGGTGAGCTGTTCCGATGGCCCCACTATGGGGCTCCACTGGCTGGGGA
  60  C  L  S  V  Q  V  V  N  C  S  R  V  F  S  L  R  P  L  G  T
 241  GTGTCTGTCTGTGCAGGTGGTCAACTGCAGCCGTGTATTCAGCCTTAGGCCTCTAGGGAC
  80  L  V  I  S  L  Q  Q  L  Q  N  A  G  H  L  V  L  R  E  A  L
 301  CCTGGTGATCTCCCTGCAGCAGCTACAGAATGCTGGGCATTTGGTGCTACGGGAAGCCCT
 100  V  D  E  N  L  Q  V  S  P  I  Q  V  E  L  D  L  K  Y  Q  P
 361  AGTGGATGAGAATCTTCAAGTGTCCCCGATCCAGGTGGAGCTTGACCTGAAGTACCAGCC
 120  P  E  G  A  T  G  A  W  S  E  E  D  F  G  A  P  I  Q  D  S
 421  CCCAGAGGGCGCTACTGGAGCCTGGTCAGAGGAGGACTTTGGGGCACCCATCCAGGACAG
 140  F  E  L  I  I  P  N  V  G  F  Q  E  L  E  P  G  E  A  Q  L
 481  CTTCGAGTTAATCATCCCCAATGTGGGCTTCCAGGAACTGGAGCCTGGGGAGGCCCAGCT
 160  E  R  R  A  V  A  L  G  R  R  L  A  R  S  L  G  Q  Q  D  D
 541  GGAGCGGCGGGCAGTGGCTCTAGGCCGCAGGCTAGCTCGAAGTCTAGGCCAGCAGGACGA
 180  E  E  N  E  L  E  L  E  Q  D  L  D  D  E  P  D  V  E
 601  TGAAGAGAATGAGCTGGAGCTTGAGCTGGAGCAGGACCTGGATGATGAGCCTGACGTGGA
 200  L  S  G  V  M  F  S  P  L  K  S  R  A  R  A  L  A  H  G  D
 661  ACTTTCTGGTGTTATGTTCAGCCCCCTCAAGAGCCGCGCCAGGGCCCTGGCCCATGGGGA
 220  P  F  Q  V  S  R  A  Q  D  F  Q  V  G  V  T  V  L  E  A  Q
 721  TCCCTTCCAGGTGTCCAGAGCTCAAGACTTCCAGGTGGGAGTCACTGTGCTGGAAGCCCA
 240  K  L  V  G  V  N  I  N  P  Y  V  A  V  Q  V  G  G  Q  R  R
 781  GAAACTGGTGGGAGTCAACATTAACCCCTATGTGGCCGTGCAAGTGGGGGGGCAGCGCCG
 260  V  T  A  T  Q  R  G  T  S  C  P  F  Y  N  E  Y  F  L  F  E
 841  TGTGACCGCCACACAGCGTGGGACCAGTTGCCCCTTCTACAATGAGTACTTCTTGTTCGA
 280  F  H  D  T  R  L  R  L  Q  D  L  L  E  I  T  V  S  G  V
 901  ATTTCATGACACGCGGCTTCGTCTCCAAGACTTGCTGCTGGAGATCACGGTGAGTGGGGT
 300  G  V  T  S  V  L  Q  R  R  G  D  E  K  A  A  G  L  T  P  P
 961  AGGGGTGACCAGTGTCCTTCAGAGAAGGGGGGATGAGAAAGCTGCAGGACTAACACCACC
 320  S  P  K  A  F  H  S  Q  T  L  P  F  M  A  T  R  I  G  T  F
1021  TTCCCCCAAGGCTTTCCATTCGCAGACCCTCCCCTTTATGGCCACCCGGATAGGCACCTT
 340  R  M  D  L  G  I  I  L  D  Q  P  D  G  Q  F  Y  Q  R  W  V
1081  CAGGATGGACCTGGGCATCATCTTGGACCAGCCAGATGGCCAGTTCTACCAAAGATGGGT
 360  P  L  H  D  P  R  D  T  R  A  G  T  K  G  F  I  K  V  T  L
1141  TCCGCTGCATGATCCCCGAGACACCCGCGCCGGGACCAAGGGTTTCATTAAGGTCACCTT
 380  S  V  R  A  R  G  D  L  P  P  P  M  L  P  P  A  P  G  H  C
1201  GTCCGTGAGGGCGCGCGGGGACCTGCCCCCTCCAATGCTACCCCCGGCCCCAGGGCACTG
 400  S  D  I  E  K  N  L  L  P  R  G  V  P  A  E  R  P  W  A
```

Figure 2M-3

```
1261 TTCGGACATCGAGAAGAACCTGCTCCTGCCCGCCGGGGTGCCCGCCGAGAGGCCATGGGC
 420   R  L  R  V  R  L  Y  R  A  E  G  L  P  A  L  R  L  G  L  L
1321 GCGGCTCCGCGTGCGCCTGTACCGCGCCGAGGGGCTTCCCGCGCTGCGCCTGGGGCTGCT
 440   G  S  L  V  R  A  L  H  D  Q  R  V  L  V  E  P  Y  V  R  V
1381 GGGCAGCCTGGTCCGCGCCCTGCACGACCAGCGCGTCCTGGTGGAGCCCTATGTGCGGGT
 460   S  F  L  G  Q  E  G  E  T  S  V  S  A  E  A  A  P  E  W
1441 GTCTTTCCTGGGGCAGGAGGGCGAGACGTCGGTGAGCGCCGAGGCGGCGGCGCCCGAATG
 480   N  E  Q  L  S  F  V  E  L  F  P  P  L  T  R  S  L  R  L  Q
1501 GAACGAGCAGCTGAGCTTCGTGGAGCTCTTCCCGCCGCTGACGCGCAGCCTCCGCCTGCA
 500   L  R  D  D  A  P  L  V  D  A  A  L  A  T  H  V  P  D  L  R
1561 GCTGCGGGACGACGCGCCCCTGGTCGACGCGGCACTCGCTACGCACGTGCCGGACCTGAG
 520   R  I  S  H  P  G  R  A  A  G  F  N  P  T  F  G  P  A  W  V
1621 GCGGATCTCCCATCCGGGCCGCGCGGCGGGGTTTAACCCTACCTTCGGCCCGGCCTGGGT
 540   P  L  Y  G  S  P  P  G  A  G  L  R  D  S  L  Q  G  L  N  E
1681 GCCCCTCTATGGCTCGCCCCCCGGCGCGGGGCTCCGGGATAGTCTTCAAGGTCTCAACGA
 560   G  V  G  Q  G  I  W  F  R  G  R  L  L  A  V  S  M  Q  V
1741 AGGCGTTGGCCAAGGCATTTGGTTCCGCGGCCGCCTTCTGCTGGCTGTGTCCATGCAGGT
 580   L  E  G  R  A  E  P  E  P  P  Q  A  Q  Q  G  S  T  L  S  R
1801 GTTGGAAGGGAGAGCTGAACCTGAGCCTCCCCAGGCCCAGCAGGGTCCACGTTGTCCCG
 600   L  T  R  K  K  K  K  A  R  R  D  Q  T  P  K  A  V  P  Q
1861 GCTCACCCGAAAGAAGAAAAAGAAAGCCAGAAGGGATCAGACCCCAAAGGCGGTTCCGCA
 620   H  L  D  A  S  P  G  A  E  G  P  E  I  P  R  A  M  E  V  E
1921 GCACTTGGACGCCAGCCCCGGTGCCGAGGGGCCTGAGATCCCCCGTGCCATGGAGGTGGA
 640   V  E  E  L  L  P  L  P  E  N  V  L  A  P  C  E  D  F  L  L
1981 GGTGGAGGAGCTGCTGCCGCTGCCAGAGAATGTCCTGGCGCCCTGTGAAGATTTCCTGCT
 660   F  G  V  L  F  E  A  T  M  I  D  P  T  V  A  S  Q  P  I  S
2041 TTTCGGTGTGCTCTTCGAGGCCACCATGATCGACCCCACCGTGGCCTCCCAGCCCATCAG
 680   F  E  I  S  I  G  R  A  G  R  L  E  E  Q  L  G  R  G  S  R
2101 CTTCGAGATCTCCATTGGTCGCGCAGGCCGTCTGGAGGAGCAATTGGGCCGAGGGTCCAG
 700   A  G  E  G  T  E  G  A  A  V  E  A  Q  P  L  L  G  A  R  P
2161 GGCTGGGGAGGGAACTGAGGGTGCAGCCGTGGAGGCTCAGCCTCTGCTGGGAGCCAGGCC
 720   E  E  E  K  E  E  E  E  L  G  T  H  A  Q  R  P  E  P  M  D
2221 AGAGGAGGAGAAAGAGGAGGAAGAACTGGGGACCCATGCTCAGCGGCCTGAGCCCATGGA
 740   G  S  G  P  Y  F  C  L  P  L  C  H  C  K  P  C  M  H  V  W
2281 CGGCAGTGGGCCATACTTCTGCTTGCCCCTCTGTCACTGCAAGCCATGCATGCATGTGTG
 760   S  C  W  E  D  H  T  W  R  L  Q  S  S  N  C  V  R  K  V  A
2341 GAGTTGCTGGGAGGACCACACCTGGCGCCTGCAGAGCAGCAACTGCGTGCGCAAAGTGGC
 780   E  R  L  D  Q  G  L  Q  E  V  E  R  L  Q  R  K  P  G  P  G
2401 CGAGAGGCTGGACCAGGGGCTGCAGGAGGTTGAGAGACTGCAGCGCAAGCCGGGGCCTGG
```

Figure 2M-4

```
 800      A  C  A  Q  L  K  Q  A  L  E  V  L  V  A  G  S  R  Q  F  C
2461 CGCCTGTGCACAGCTCAAGCAGGCACTGGAAGTACTGGTGGCTGGGAGCAGACAGTTTTG
 820      H  G  A  E  R  R  T  M  T  R  P  N  A  L  D  R  C  R  G  K
2521 CCACGGTGCCGAGCGCAGGACGATGACCCGGCCCAATGCCCTGGATCGATGCCGAGGGAA
 840      L  L  V  H  S  L  N  L  L  A  K  Q  G  L  R  L  L  R  G  L
2581 ACTCCTGGTGCACAGCCTGAACCTTTTGGCTAAGCAAGGACTGCGACTTCTACGCGGCCT
 860      R  R  N  V  Q  K  K  V  A  L  A  K  K  L  L  A  K  L  R
2641 GAGACGGCGCAATGTGCAAAAGAAGGTGGCACTGGCCAAGAAGCTCCTGGCAAAACTGCG
 880      F  L  A  E  E  P  Q  P  P  L  P  D  V  L  V  W  M  L  S  G
2701 CTTTCTGGCTGAGGAGCCCCAGCCACCCCTCCCCGATGTGCTGGTCTGGATGCTCAGCGG
 900      Q  R  R  V  A  W  A  R  I  P  A  Q  D  V  L  F  S  V  V  E
2761 GCAGCGCCGTGTGGCCTGGGCCCGGATCCCTGCCCAGGATGTGCTGTTCTCTGTGGTTGA
 920      E  E  R  G  R  D  C  G  K  I  Q  S  L  M  L  T  A  P  G  A
2821 GGAGGAACGGGGCCGAGACTGTGGGAAGATCCAGAGTCTAATGCTCACGGCACCCGGGGC
 940      A  P  G  E  V  C  A  K  L  E  L  F  L  R  L  G  L  G  K  Q
2881 AGCCCCTGGTGAGGTCTGTGCCAAGCTGGAGCTCTTCCTGCGGCTGGGCCTGGGCAAGCA
 960      A  K  A  C  T  S  E  L  P  P  D  L  L  P  E  P  S  A  G  L
2941 AGCCAAGGCCTGCACCTCTGAGCTGCCCCCGGATTTGCTGCCCGAGCCCTCAGCCGGGCT
 980      P  S  S  L  H  R  D  D  F  S  Y  F  Q  L  R  A  H  L  Y  Q
3001 GCCCTCCAGCCTACACCGGGACGACTTTAGCTACTTCCAACTCCGGGCTCACTTGTACCA
1000      A  R  G  V  L  A  A  D  D  S  G  L  S  D  P  F  A  R  V  L
3061 GGCCCGGGGTGTGTTGGCTGCAGATGACAGTGGCCTCTCGGACCCCTTTGCTCGAGTCCT
1020      I  S  T  Q  C  Q  T  T  R  V  L  E  Q  T  L  S  P  L  W  D
3121 CATCTCTACCCAGTGTCAGACCACACGGGTCCTGGAGCAGACGCTGAGCCCTCTGTGGGA
1040      E  L  L  V  F  E  Q  L  I  V  D  G  R  R  E  H  L  Q  E  E
3181 TGAACTCCTGGTATTTGAGCAGTTGATCGTGGATGGGAGGAGGGAGCACCTGCAGGAGGA
1060      P  P  L  V  I  I  N  V  F  D  H  N  K  F  G  P  P  V  F  L
3241 GCCTCCATTAGTGATCATCAATGTATTTGACCACAATAAGTTTGGCCCCCCCGTGTTCCT
1080      G  R  A  L  A  A  P  R  V  K  L  M  E  D  P  Y  Q  R  P  E
3301 GGGCAGGGCACTGGCCGCCCCAAGGGTAAAGCTGATGGAGGACCCATACCAACGCCCAGA
1100      L  Q  F  F  P  L  R  K  G  P  W  A  A  G  E  L  I  A  A  F
3361 GTTGCAGTTCTTCCCCCTGAGGAAGGGACCCTGGGCAGCCGGAGAGCTCATTGCCGCCTT
1120      Q  L  I  E  L  D  Y  S  G  R  L  E  P  S  V  P  S  E  V  E
3421 TCAACTCATTGAACTAGACTACAGTGGCCGACTTGAGCCCTCAGTGCCCAGTGAGGTGGA
1140      P  Q  D  L  A  P  L  V  E  P  H  S  G  R  L  S  L  P  P  N
3481 GCCCCAGGATCTGGCACCCCTGGTTGAGCCCCACTCTGGACGCCTGTCCCTTCCACCCAA
1160      V  C  P  V  L  R  E  F  R  V  E  V  L  F  W  G  L  R  G  L
3541 CGTGTGCCCAGTGCTCAGGGAGTTCCGTGTTGAGGTGCTGTTCTGGGGTCTTAGGGGACT
1180      G  R  V  H  L  L  E  V  E  Q  P  Q  V  V  L  E  V  A  G  Q
```

Figure 2M-5

```
3601 TGGTCGTGTGCATCTGCTCGAGGTGGAGCAGCCCCAGGTTGTACTGGAGGTGGCTGGGCA
1200  G  V  E  S  E  V  L  A  S  Y  R  E  S  P  N  F  T  E  L  V
3661 AGGTGTGGAGTCTGAGGTCCTGGCCAGCTACCGTGAGAGCCCCAATTTCACTGAGCTTGT
1220  R  H  L  T  V  V  F  K  D  T  A  P  L  F  H  P  Q  D  L  P
3721 CAGGCATCTGACAGTGGTCTTCAAAGACACAGCTCCTCTCTTCCACCCCCAGGACTTGCC
1240  E  Q  P  Y  L  Q  P  P  L  S  I  L  V  I  E  R  R  A  F  G
3781 GGAGCAGCCTTACTTGCAGCCTCCACTCAGCATCTTGGTGATTGAGCGCCGGGCCTTTGG
1260  H  T  V  L  V  G  S  H  I  V  P  H  M  L  R  F  T  F  R  G
3841 CCACACAGTCCTTGTGGGTTCCCACATTGTCCCCCACATGCTGCGATTCACATTTCGGGG
1280  H  E  D  P  P  E  E  E  G  E  M  E  E  T  G  D  M  M  P  K
3901 TCATGAGGATCCTCCTGAGGAGGAAGGAGAGATGGAGGAGACAGGGGATATGATGCCCAA
1300  G  P  Q  G  Q  K  S  L  D  P  F  L  A  E  A  G  I  S  R  Q
3961 GGGACCTCAAGGACAGAAGTCCCTGGATCCCTTCTTGGCTGAAGCGGGTATATCCAGACA
1320  L  L  K  P  P  L  K  K  L  P  L  G  G  L  L  N  Q  G  P  G
4021 GCTCCTGAAGCCTCCTCTGAAGAAGCTCCCACTAGGAGGCCTCCTAAATCAAGGCCCTGG
1340  L  E  E  D  I  P  D  P  E  E  L  D  W  G  S  K  Y  Y  A  S
4081 GCTGGAGGAAGACATCCCAGATCCAGAGGAGCTCGACTGGGGGTCCAAGTACTATGCGTC
1360  L  Q  E  L  Q  G  Q  H  N  F  D  E  D  E  M  D  D  P  G  D
4141 GCTGCAGGAGCTCCAGGGGCAGCACAACTTTGATGAAGATGAAATGGATGATCCTGGAGA
1380  S  D  G  V  N  L  I  S  M  V  G  E  I  Q  D  Q  G  E  A  E
4201 TTCAGATGGGGTCAACCTCATTTCTATGGTTGGGGAGATCCAAGACCAGGGTGAGGCTGA
1400  V  K  G  T  V  S  P  K  K  A  V  A  T  L  K  I  Y  N  R  S
4261 AGTCAAAGGCACTGTGTCCCCAAAAAAAGCAGTTGCCACCCTGAAGATCTACAACAGGTC
1420  L  K  E  E  F  N  H  F  E  D  W  L  N  V  F  P  L  Y  R  G
4321 CCTGAAGGAAGAATTTAACCACTTTGAAGACTGGCTGAATGTGTTTCCTCTGTACCGAGG
1440  Q  G  C  Q  D  G  G  E  E  C  S  H  L  V  G  K  F
4381 GCAAGGGGGCCAGGATGGAGGTGGAGAAGAGGAAGGATCTGGACACCTTGTGGGCAAGTT
1460  K  G  S  F  L  I  Y  P  E  S  E  A  V  L  F  S  E  P  Q  I
4441 CAAGGGCTCCTTCCTCATTTACCCTGAATCAGAGGCAGTGTTGTTCTCTGAGCCCCAGAT
1480  S  R  G  I  P  Q  N  R  P  I  K  L  L  V  R  V  Y  V  V  K
4501 CTCCCGGGGGATCCCACAGAACCGGCCCATCAAGCTCCTGGTCAGAGTGTATGTTGTAAA
1500  A  T  N  L  A  P  D  P  N  G  K  A  D  P  Y  V  V  V  S
4561 GGCTACCAACCTGGCTCCTGCAGACCCCAATGGCAAAGCAGACCCTTACGTGGTGGTGAG
1520  A  G  R  E  R  Q  D  T  K  E  R  Y  I  P  K  Q  L  N  P  I
4621 CGCTGGCCGGGAGCGGCAGGACACCAAGGAACGCTACATCCCCAAGCAGCTCAACCCCAT
1540  F  G  E  I  L  E  L  S  I  S  L  P  A  E  T  E  L  T  V  A
4681 CTTTGGAGAGATCCTGGAGCTAAGCATCTCTCTCCCAGCTGAGACGGAGCTGACGGTCGC
1560  V  F  D  H  D  L  V  G  S  D  D  L  I  G  E  T  H  I  D  L
4741 CGTATTTGATCATGACCTCGTGGGTTCTGACGACCTCATCGGGGAGACCCACATTGATCT
```

Figure 2M-6

```
1580  E  N  R  F  Y  S  H  H  R  A  N  C  G  L  A  S  Q  Y  E  V
4801  GGAAAACCGATTCTATAGCCACCACAGAGCAAACTGTGGGCTGGCCTCCCAGTATGAAGT
1600  D  G  Y  N  A  W  R  D  A  F  W  P  S  Q  I  L  A  G  L  C
4861  AGATGGTTACAATGCCTGGCGTGATGCATTCTGGCCTTCGCAGATCCTGGCGGGGCTGTG
1620  Q  R  C  G  L  P  A  P  E  Y  R  A  G  A  V  K  V  G  S  K
4921  CCAACGCTGTGGCCTCCCTGCCCCTGAATACCGAGCCGGTGCTGTCAAGGTGGGCAGCAA
1640  V  F  L  T  P  P  E  T  L  P  P  V  A  S  G  D  P  E  E  A
4981  AGTCTTCCTGACACCACCGGAGACCCTGCCCCCAGTGGCGAGCGGGGACCCTGAAGAGGC
1660  Q  A  L  L  V  L  R  R  W  Q  E  M  P  G  F  G  I  Q  L  V
5041  CCAGGCATTGCTTGTGCTGCGGCGCTGGCAGGAAATGCCGGGTTTTGGGATCCAGCTGGT
1680  P  E  H  V  E  T  R  P  L  Y  H  P  H  S  P  G  L  L  Q  G
5101  ACCCGAGCATGTAGAAACCAGGCCTCTCTACCATCCCCACAGCCCAGGGCTGCTACAGGG
1700  S  L  H  M  W  I  D  I  F  P  Q  D  V  P  A  P  P  P  V  D
5161  ATCTCTTCACATGTGGATTGACATCTTTCCTCAAGATGTGCCTGCTCCACCCCCAGTTGA
1720  I  K  P  R  Q  P  I  S  Y  E  L  R  V  V  I  W  N  T  E  D
5221  CATCAAGCCTCGGCAGCCAATCAGCTATGAGCTCAGAGTTGTCATCTGGAACACGGAGGA
1740  V  V  L  D  D  E  N  P  L  T  G  E  M  S  S  D  I  Y  V  K
5281  TGTGGTTCTGGATGACGAGAATCCACTCACCGGAGAGATGTCGAGTGACATCTATGTGAA
1760  S  W  V  K  G  L  E  H  D  K  Q  E  T  D  V  H  F  N  S  L
5341  GAGCTGGGTGAAGGGGTTGGAGCATGACAAGCAGGAGACAGACGTTCACTTCAACTCCCT
1780  T  G  E  G  N  F  N  W  R  F  V  F  R  F  D  Y  L  P  T  E
5401  GACTGGGGAGGGGAACTTCAATTGGCGCTTTGTGTTCCGCTTTGACTACCTGCCCACGGA
1800  R  E  V  S  V  W  R  R  S  G  P  F  A  L  E  E  A  E  F  R
5461  GCGGGAGGTGAGCGTCTGGCGCAGGTCTGGACCCTTTGCCCTGGAGGAGGCGGAGTTCCG
1820  Q  P  A  V  L  V  L  Q  V  W  D  Y  D  R  I  S  A  N  D  F
5521  GCAGCCTGCAGTGCTGGTCCTGCAGGTCTGGGACTATGACCGCATCTCTGCCAATGACTT
1840  L  G  S  L  E  L  Q  L  P  D  M  V  R  G  A  R  G  P  E  L
5581  CCTTGGATCCCTGGAGTTGCAGCTACCAGACATGGTGCGTGGGGCCCGGGGCCCCGAGCT
1860  C  S  V  Q  L  A  R  N  G  A  G  P  R  C  N  L  F  R  C  R
5641  CTGCTCTGTGCAGCTGGCCCGCAATGGGGCCGGGCCGAGGTGCAATCTGTTTCGCTGCCG
1880  R  L  R  G  W  W  P  V  V  K  L  K  E  A  E  D  G  K  V  E
5701  CCGCCTGAGGGGCTGGTGGCCGGTAGTGAAGCTGAAGGAGGCAGAGGACGGCAAGGTGGA
1900  A  E  F  E  L  L  T  V  E  E  A  E  K  R  P  V  G  K  G  R
5761  GGCAGAGTTTGAGCTGCTGACTGTGGAGGAGGCCGAGAAACGGCCAGTGGGGAAGGGGCG
1920  K  Q  P  E  P  L  E  K  P  S  R  P  K  T  S  F  N  W  F  V
5821  GAAGCAGCCAGAGCCTCTGGAGAAACCCAGCCGCCCCAAAACTTCCTTCAACTGGTTTGT
1940  N  P  L  K  T  F  V  F  F  I  W  R  R  Y  W  R  T  L  V  L
5881  GAACCCGCTGAAGACCTTTGTCTTCTTCATCTGGCGCCGGTACTGGCGCACCCTGGTGCT
1960  L  L  L  V  L  L  T  V  F  L  L  L  V  F  Y  T  I  P  C  Q
```

Figure 2M-7

```
5941 GCTGCTACTGGTGCTGCTCACCGTCTTCCTCCTCCTGGTCTTCTACACCATCCCTGGCCA
1980  I  S  Q  V  I  F  R  P  L  H  K  *
6001 GATCAGCCAGGTCATCTTCCGTCCCCTCCACAAGTGActctcgctgaccttggacactca
6061 cccagggtgccaaccct tcaatgcctgctcctggaagtctttcttacccatgtgagctac
6121 cccagagtctagtgcttcctctgaataaacctatcacagcc
```

Figure 2N. The cDNA (SEQ ID NO:28) and amino acid sequence (SEQ ID NO:29) of 158P3D2 v.17.

```
  1 caggtgggcgggctggtgggcagaagggcagacgggcagaggaagtgccagtgccactgg
  1    M  A  L  T  V  S  V  Q  R  L  T  G  L  T  G  T  H  D  R
 61 gaccATGGCTCTGACGGTAAGCGTGCAACGACTAACAGGGCTGACCGGCACCCACGACCG
 20 Q  V  K  L  T  F  R  G  F  T  Q  K  T  R  K  I  H  C  G  P
121 ACAAGTGAAGCTCACCTTTCGAGGCTTTACCCAGAAAACAAGAAAAATTCACTGTGGTCC
 40 E  A  D  I  G  E  L  F  R  W  P  H  Y  G  A  P  L  A  G  E
181 AGAAGCAGATATCGGTGAGCTGTTCCGATGGCCCCACTATGGGGCTCCACTGGCTGGGGA
 60 C  L  S  V  Q  V  V  N  C  S  R  V  F  S  L  R  P  L  G  T
241 GTGTCTGTCTGTGCAGGTGGTCAACTGCAGCCGTGTATTCAGCCTTAGGCCTCTAGGGAC
 80 L  V  I  S  L  Q  Q  L  Q  N  A  G  H  L  V  L  R  E  A  L
301 CCTGGTGATCTCCCTGCAGCAGCTACAGAATGCTGGGCATTTGGTGCTACGGGAAGCCCT
100 V  D  E  N  L  Q  V  S  P  I  Q  V  E  L  D  L  K  Y  Q  P
361 AGTGGATGAGAATCTTCAAGTGTCCCCGATCCAGGTGGAGCTTGACCTGAAGTACCAGCC
120 P  E  G  A  T  G  A  W  S  E  D  F  G  A  P  T  Q  D  S
421 CCCAGAGGGCGCTACTGGAGCCTGGTCAGAGGAGGACTTTGGGGCACCCATCCAGGACAG
140 F  E  L  I  I  P  N  V  G  F  Q  E  L  E  P  G  E  A  Q  L
481 CTTCGAGTTAATCATCCCCAATGTGGGCTTCCAGGAACTGGAGCCTGGGGAGGCCCAGCT
160 E  R  R  A  V  L  G  R  R  L  A  R  S  L  G  Q  Q  D  D
541 GGAGCGGCGGGCAGTGGCTCTAGGCCGCAGGCTAGCTCGAAGTCTAGGCCAGCAGGACGA
180 E  E  N  E  L  E  L  E  Q  D  L  D  D  E  P  D  V  E
601 TGAAGAGAATGAGCTGGAGCTTGAGCTGGAGCAGGACCTGGATGATGAGCCTGACGTGGA
200 L  S  G  V  M  F  S  P  L  K  S  R  A  R  A  L  A  H  G  D
661 ACTTTCTGGTGTTATGTTCAGCCCCCTCAAGAGCCGCGCCAGGGCCCTGGCCCATGGGGA
220 P  F  Q  V  S  R  A  Q  D  F  Q  V  G  V  T  V  L  E  A  Q
721 TCCCTTCCAGGTGTCCAGAGCTCAAGACTTCCAGGTGGGAGTCACTGTGCTGGAAGCCCA
240 K  L  V  G  V  N  I  N  P  Y  V  A  V  Q  V  G  G  Q  R  R
781 GAAACTGGTGGGAGTCAACATTAACCCCTATGTGGCCGTGCAAGTGGGGGGGCAGCGCCG
260 V  T  A  T  Q  R  G  T  S  C  P  F  Y  N  E  Y  F  L  F  E
841 TGTGACCGCCACACAGCGTGGGACCAGTTGCCCCTTCTACAATGAGTACTTCTTGTTCGA
```

Figure 2N-2

```
 280  F  H  D  T  R  L  R  L  Q  D  L  L  L  E  I  T  V  S  G  V
 901 ATTTCATGACACGCGGCTTCGTCTCCAAGACTTGCTGCTGGAGATCACGGTGAGTGGGGT
 300  G  V  T  S  V  L  Q  R  R  G  D  E  K  A  A  G  L  T  P  P
 961 AGGGGTGACCAGTGTCCTTCAGAGAAGGGGGGATGAGAAAGCTGCAGGACTAACACCACC
 320  S  P  K  A  F  H  S  Q  T  L  P  F  M  A  T  R  I  G  T  F
1021 TTCCCCCAAGGCTTTCCATTCGCAGACCCTCCCCTTTATGGCCACCCGGATAGGCACCTT
 340  R  M  D  L  G  I  I  L  D  Q  P  D  G  Q  F  Y  Q  R  W  V
1081 CAGGATGGACCTGGGCATCATCTTGGACCAGCCAGATGGCCAGTTCTACCAAAGATGCGT
 360  P  L  H  D  P  R  D  T  R  A  G  T  K  G  F  I  K  V  T  L
1141 TCCGCTGCATGATCCCCGAGACACCCGCGCCGGGACCAAGGGTTTCATTAAGGTCACCTT
 380  S  V  R  A  R  G  D  L  P  P  P  M  L  P  P  A  P  G  H  C
1201 GTCCGTGAGGGCGCGCGGGACCTGCCCCCTCCAATGCTACCCCCGGCCCCAGGGCACTG
 400  S  D  T  E  K  N  L  L  L  P  R  G  V  P  A  E  R  P  W  A
1261 TTCGGACATCGAGAAGAACCTGCTCCTGCCGCGCGGGGTGCCCGCCGAGAGGCCATGGGC
 420  R  L  R  V  R  L  Y  R  A  E  G  L  P  A  L  R  L  G  L  L
1321 GCGGCTCCGCGTGCGCCTGTACCGCGCCGAGGGGCTTCCCGCGCTGCGCCTGGGGCTGCT
 440  G  S  L  V  R  A  L  H  D  Q  R  V  L  V  E  P  Y  V  R  V
1381 GGGCAGCCTGGTCCGCGCCCTGCACGACCAGCGCGTCCTGGTGGAGCCCTATGTGCGGGT
 460  S  F  L  G  Q  E  G  E  T  S  V  S  A  E  A  A  A  P  E  W
1441 GTCTTTCCTGGGGCAGGAGGGCGAGACGTCGGTGAGCGCCGAGGCGGCGGCGCCCGAATG
 480  N  E  Q  L  S  F  V  E  L  F  P  P  L  T  R  S  L  R  L  Q
1501 GAACGAGCAGCTGAGCTTCGTGGAGCTCTTCCCGCCGCTGACGCGCAGCCTCCGCCTGCA
 500  L  R  D  D  A  P  L  V  D  A  A  L  A  T  H  V  P  D  L  R
1561 GCTGCGGGACGACGCGCCCCTGGTCGACGCGGCACTCGCTACGCACGTGCCGGACCTGAG
 520  R  I  S  H  P  G  R  A  A  G  F  N  P  T  F  G  P  A  W  V
1621 GCGGATCTCCCATCCGGGCCGCGCGGCGGGGTTTAACCCTACCTTCGGCCCGGCCTGGGT
 540  P  L  Y  G  S  P  P  G  A  G  L  R  D  S  L  Q  G  L  N  E
1681 GCCCCTCTATGGCTCGCCCCCGGCGCGGGGCTCCGGGATAGTCTTCAAGGTCTCAACGA
 560  G  V  G  Q  G  I  W  F  R  G  R  L  L  A  V  S  M  Q  V
1741 AGGCGTTGGCCAAGGCATTTGGTTCCGCGGCCGCCTTCTGCTGGCTGTGTCCATGCAGGT
 580  L  E  G  R  A  E  P  E  P  P  Q  A  Q  Q  G  S  T  L  S  R
1801 GTTGGAAGGGAGAGCTGAACCTGAGCCTCCCCAGGCCCAGCAGGGGTCCACGTTGTCCCG
 600  L  T  R  K  K  K  K  A  R  R  D  Q  T  P  K  A  V  P  Q
1861 GCTCACCCGAAAGAAGAAAAAGAAAGCCAGAAGGGATCAGACCCCAAAGGCGGTTCCGCA
 620  H  L  D  A  S  P  G  A  E  G  P  E  I  P  R  A  M  E  V  E
1921 GCACTTGGACGCCAGCCCCGGTGCCGAGGGGCCTGAGATCCCCGTGCCATGGAGGTGGA
 640  V  E  E  L  L  P  L  P  E  N  V  L  A  P  C  E  D  F  L  L
1981 GGTGGAGGAGCTGCTGCCGCTGCCAGAGAATGTCCTGGCGCCCTGTGAAGATTTCCTGCT
 660  F  G  V  L  F  E  A  T  M  I  D  P  T  V  A  S  Q  P  I  S
```

Figure 2N-3

```
2041 TTTCGGTGTGCTCTTCGAGGCCACCATGATCGACCCCACCGTGGCCTCCCAGCCCATCAG
 680  F   E   I   S   I   G   R   A   G   R   L   E   E   Q   L   G   R   G   S   R
2101 CTTCGAGATCTCCATTGGTCGCGCAGGCCGTCTGGAGGAGCAATTGGGCCGAGGGTCCAG
 700  A   G   E   G   T   E   G   A   A   V   E   A   Q   P   L   L   G   A   R   P
2161 GGCTGGGGAGGGAACTGAGGGTGCAGCCGTGGAGGCTCAGCCTCTGCTGGGAGCCAGGCC
 720  E   E   E   K   E   E   E   E   L   G   T   H   Q   R   P   E   P   M   D
2221 AGAGGAGGAGAAAGAGGAGGAAGAACTGGGGACCCATGCTCAGCGGCCTGAGCCCATGGA
 740  G   S   G   P   Y   F   C   L   P   L   C   H   C   K   P   C   M   H   V   W
2281 CGGCAGTGGGCCATACTTCTGCTTGCCCCTCTGTCACTGCAAGCCATGCATGCATGTGTG
 760  S   W   E   D   H   T   W   R   L   Q   S   S   N   C   V   R   K   V   A
2341 GAGTTGCTGGAGGACCACACCTGGCGCCTGCAGAGCAGCAACTGCGTGCGCAAAGTGGC
 780  E   R   L   D   Q   G   L   Q   E   V   E   R   L   Q   R   K   P   G   P   G
2401 CGAGAGGCTGGACCAGGGGCTGCAGGAGGTTGAGAGACTGCAGCGCAAGCCGGGGCCTGG
 800  A   C   A   Q   L   K   Q   A   L   E   V   L   V   A   G   S   R   Q   F   C
2461 CGCCTGTGCACAGCTCAAGCAGGCACTGGAAGTACTGGTGGCTGGGAGCAGACAGTTTTG
 820  H   G   A   E   R   R   T   M   T   R   P   N   A   L   D   R   C   R   G   K
2521 CCACGGTGCCGAGCGCAGGACGATGACCCGGCCCAATGCCCTGGATCGATGCCGAGGGAA
 840  L   L   V   H   S   L   N   L   L   A   K   Q   G   L   R   L   L   R   G   L
2581 ACTCCTGGTGCACAGCCTGAACCTTTTGGCTAAGCAAGGACTGCGACTTCTACGCGGCCT
 860  R   R   R   N   V   Q   K   K   V   A   L   A   K   K   L   L   A   K   L   R
2641 GAGACGGCGCAATGTGCAAAAGAAGGTGGCACTGGCCAAGAAGCTCCTGGCAAAACTGCG
 880  F   L   A   E   E   P   Q   P   P   L   P   D   V   L   V   W   M   L   S   G
2701 CTTTCTGGCTGAGGAGCCCCAGCCACCCCTCCCCGATGTGCTGGTCTGGATGCTCAGCGG
 900  Q   R   R   V   A   W   A   R   I   P   A   Q   D   V   L   F   S   V   V   E
2761 GCAGCGCCGTGTGGCCTGGGCCCGGATCCCTGCCCAGGATGTGCTGTTCTCTGTGGTTGA
 920  E   E   R   G   R   D   C   G   K   I   Q   S   L   M   L   T   A   P   G   A
2821 GGAGGAACGGGGCCGAGACTGTGGGAAGATCCAGAGTCTAATGCTCACGGCACCCGGGGC
 940  A   P   G   E   V   C   A   K   L   E   L   F   L   R   L   G   L   G   K   Q
2881 AGCCCCTGGTGAGGTCTGTGCCAAGCTGGAGCTCTTCCTGCGGCTGGGCCTGGGCAAGCA
 960  A   K   A   C   T   S   E   L   P   P   D   L   L   P   E   P   S   A   G   L
2941 AGCCAAGGCCTGCACCTCTGAGCTGCCCCCGGATTTGCTGCCCGAGCCCTCAGCCGGGCT
 980  P   S   S   L   H   R   D   D   F   S   Y   F   Q   L   R   A   H   L   Y   Q
3001 GCCCTCCAGCCTACACCGGGACGACTTTAGCTACTTCCAACTCCGGGCTCACTTGTACCA
1000  A   R   G   V   L   A   A   D   D   S   G   L   S   D   P   F   A   R   V   L
3061 GGCCCGGGGTGTGTTGGCTGCAGATGACAGTGGCCTCTCGGACCCCTTTGCTCGAGTCCT
1020  I   S   T   Q   C   Q   T   T   R   V   L   E   Q   T   L   S   P   L   W   D
3121 CATCTCTACCCAGTGTCAGACCACACGGGTCCTGGAGCAGACGCTGAGCCCTCTGTGGGA
1040  E   L   L   V   F   E   Q   L   I   V   D   G   R   R   E   H   L   Q   E   E
3181 TGAACTCCTGGTATTTGAGCAGTTGATCGTGGATGGGAGGAGGGAGCACCTGCAGGAGGA
```

Figure 2N-4

```
1060  P  P  L  V  I  I  N  V  F  D  H  N  K  F  G  P  P  V  F  L
3241 GCCTCCATTAGTGATCATCAATGTATTTGACCACAATAAGTTTGGCCCCCCCGTGTTCCT
1080  G  R  A  L  A  A  P  R  V  K  L  M  E  D  P  Y  Q  R  P  E
3301 GGGCAGGGCACTGGCCGCCCCAAGGGTAAAGCTGATGGAGGACCCATACCAACGCCCAGA
1100  L  Q  F  F  P  L  R  K  G  P  W  A  A  G  E  L  I  A  A  F
3361 GTTGCAGTTCTTCCCCCTGAGGAAGGGACCCTGGGCAGCCGGAGAGCTCATTGCCGCCTT
1120  Q  L  I  E  L  D  Y  S  G  R  L  E  P  S  V  P  S  E  V  E
3421 TCAACTCATTGAACTAGACTACAGTGGCCGACTTGAGCCCTCAGTGCCCAGTGAGGTGGA
1140  P  Q  D  L  A  P  L  V  E  P  H  S  G  R  L  S  L  P  P  N
3481 GCCCCAGGATCTGGCACCCCTGGTTGAGCCCCACTCTGGACGCCTGTCCCTTCCACCCAA
1160  V  C  P  V  L  R  E  F  R  V  E  V  L  F  W  G  L  R  G  L
3541 CGTGTGCCCAGTGCTCAGGGAGTTCCGTGTTGAGGTGCTGTTCTGGGGTCTTAGGGGACT
1180  G  R  V  H  L  L  E  V  E  Q  P  Q  V  V  L  E  V  A  G  Q
3601 TGGTCGTGTGCATCTGCTCGAGGTGGAGCAGCCCCAGGTTGTACTGGAGGTGGCTGGGCA
1200  G  V  E  S  E  V  L  A  S  Y  R  E  S  P  N  F  T  E  L  V
3661 AGGTGTGGAGTCTGAGGTCCTGGCCAGCTACCGTGAGAGCCCCAATTTCACTGAGCTTGT
1220  R  H  L  T  V  V  F  K  D  T  A  P  L  F  H  P  Q  D  L  P
3721 CAGGCATCTGACAGTGGTCTTCAAAGACACAGCTCCTCTCTTCCACCCCCAGGACTTGCC
1240  E  Q  P  Y  L  Q  P  P  L  S  I  L  V  I  E  R  R  A  F  G
3781 GGAGCAGCCTTACTTGCAGCCTCCACTCAGCATCTTGGTGATTGAGCGCCGGGCCTTTGG
1260  H  T  V  L  V  G  S  H  I  V  P  H  M  L  R  F  T  F  R  G
3841 CCACACAGTCCTTGTGGGTTCCCACATTGTCCCCCACATGCTGCGATTCACATTTCGGGG
1280  H  E  D  P  P  E  E  G  E  M  E  E  T  G  D  M  M  P  K
3901 TCATGAGGATCCTCCTGAGGAGGAAGGAGAGATGGAGGAGACAGGGGATATGATGCCCAA
1300  G  P  Q  G  Q  K  S  L  D  P  F  L  A  E  A  G  I  S  R  Q
3961 GGGACCTCAAGGACAGAAGTCCCTGGATCCCTTCTTGGCTGAAGCGGGTATATCCAGACA
1320  L  L  K  P  P  L  K  K  L  P  L  G  G  L  L  N  Q  G  P  G
4021 GCTCCTGAAGCCTCCTCTGAAGAAGCTCCCACTAGGAGGCCTCCTAAATCAAGGCCCTGG
1340  L  E  E  D  I  P  D  P  E  E  L  D  W  G  S  K  Y  Y  A  S
4081 GCTGGAGGAAGACATCCCAGATCCAGAGGAGCTCGACTGGGGGTCCAAGTACTATGCGTC
1360  L  Q  E  L  Q  G  Q  H  N  F  D  E  D  E  M  D  D  P  G  D
4141 GCTGCAGGAGCTCCAGGGGCAGCACAACTTTGATGAAGATGAAATGGATGATCCTGGAGA
1380  S  D  G  V  N  L  I  S  M  V  G  E  I  Q  D  Q  G  E  A  E
4201 TTCAGATGGGGTCAACCTCATTTCTATGGTTGGGGAGATCCAAGACCAGGGTGAGGCTGA
1400  V  K  G  T  V  S  P  K  K  A  V  A  T  L  K  I  Y  N  R  S
4261 AGTCAAAGGCACTGTGTCCCCAAAAAAAGCAGTTGCCACCCTGAAGATCTACAACAGGTC
1420  L  K  E  E  F  N  H  F  E  D  W  L  N  V  F  P  L  Y  R  G
4321 CCTGAAGGAAGAATTTAACCACTTTGAAGACTGGCTGAATGTGTTTCCTCTGTACCGAGG
1440  Q  G  G  Q  D  G  G  G  F  E  E  G  S  G  H  L  V  G  K  F
```

Figure 2N-5

```
4381 GCAAGGGGGCCAGGATGGAGGTGGAGAAGAGGAAGGATCTGGACACCTTGTGGGCAAGTT
1460  K  G  S  F  L  I  Y  P  E  S  E  A  V  L  F  S  E  P  Q  I
4441 CAAGGGCTCCTTCCTCATTTACCCTGAATCAGAGGCAGTGTTGTTCTCTGAGCCCCAGAT
1480  S  R  G  I  P  Q  N  R  P  I  K  L  L  V  R  V  Y  V  V  K
4501 CTCCCGGGGATCCCACAGAACCGGCCCATCAAGCTCCTGGTCAGAGTGTATGTTGTAAA
1500  A  T  N  L  A  P  A  D  P  N  G  K  A  D  P  Y  V  V  S
4561 GGCTACCAACCTGGCTCCTGCAGACCCCAATGGCAAAGCAGACCCTTACGTGGTGGTGAG
1520  A  G  R  E  R  Q  D  T  K  E  R  Y  I  P  K  Q  L  N  P  I
4621 CGCTGGCCGGGAGCGGCAGGACACCAAGGAACGCTACATCCCCAAGCAGCTCAACCCCAT
1540  F  G  E  I  L  E  L  S  I  S  L  P  A  E  T  E  L  T  V  A
4681 CTTTGGAGAGATCCTGGAGCTAAGCATCTCTCTCCCAGCTGAGACGGAGCTGACGGTCGC
1560  V  F  D  H  D  L  V  G  S  D  D  L  I  G  E  T  H  I  D  L
4741 CGTATTTGATCATGACCTCGTGGGTTCTGACGACCTCATCGGGGAGACCCACATTGATCT
1580  E  N  R  F  Y  S  H  H  R  A  N  C  G  L  A  S  Q  Y  E  V
4801 GGAAAACCGATTCTATAGCCACCACAGAGCAAACTGTGGGCTGGCCTCCCAGTATGAAGT
1600  D  G  Y  N  A  W  R  D  A  F  W  P  S  Q  I  L  A  G  L  C
4861 AGATGGTTACAATGCCTGGCGTGATGCATTCTGGCCTTCGCAGATCCTGGCGGGGCTGTG
1620  Q  R  C  G  L  P  A  P  E  Y  R  A  G  A  V  K  V  G  S  K
4921 CCAACGCTGTGGCCTCCCTGCCCCTGAATACCGAGCCGGTGCTGTCAAGGTGGGCAGCAA
1640  V  F  L  T  P  P  E  T  L  P  P  G  S  S  S  P  T  V  A  S
4981 AGTCTTCCTGACACCACCGGAGACCCTGCCCCCAGGCAGCAGCAGCCCCACAGTGGCGAG
1660  G  D  P  E  E  A  Q  A  L  L  V  L  R  R  W  Q  E  M  P  G
5041 CGGGGACCCTGAAGAGGCCCAGGCATTGCTTGTGCTGCGGCGCTGGCAGGAAATGCCGGG
1680  F  G  I  Q  L  V  P  E  H  V  E  T  R  P  L  Y  H  P  H  S
5101 TTTTGGGATCCAGCTGGTACCCGAGCATGTAGAAACCAGGCCTCTCTACCATCCCCACAG
1700  P  G  L  L  Q  G  S  L  H  M  W  I  D  I  F  P  Q  D  V  P
5161 CCCAGGGCTGCTACAGGGATCTCTTCACATGTGGATTGACATCTTTCCTCAAGATGTGCC
1720  A  P  P  P  V  D  I  K  P  R  Q  P  I  S  Y  E  L  R  V  V
5221 TGCTCCACCCCCAGTTGACATCAAGCCTCGGCAGCCAATCAGCTATGAGCTCAGAGTTGT
1740  I  W  N  T  E  D  V  V  L  D  D  E  N  P  L  T  G  E  M  S
5281 CATCTGGAACACGGAGGATGTGGTTCTGGATGACGAGAATCCACTCACCGGAGAGATGTC
1760  S  D  I  Y  V  K  S  W  V  K  G  L  E  H  D  K  Q  E  T  D
5341 GAGTGACATCTATGTGAAGAGCTGGGTGAAGGGGTTGGAGCATGACAAGCAGGAGACAGA
1780  V  H  F  N  S  L  T  G  E  G  N  F  N  W  R  F  V  R  F
5401 CGTTCACTTCAACTCCCTGACTGGGGAGGGGAACTTCAATTGGCGCTTTGTGTTCCGCTT
1800  D  Y  L  P  T  E  R  E  V  S  V  W  R  R  S  G  P  F  A  L
5461 TGACTACCTGCCCACGGAGCGGGAGGTGAGCGTCTGGCGCAGGTCTGGACCCTTTGCCCT
1820  E  E  A  E  F  R  Q  P  A  V  L  V  L  Q  V  W  D  Y  D  R
5521 GGAGGAGGCGGAGTTCCGGCAGCCTGCAGTGCTGGTCCTGCAGGTCTGGGACTATGACCG
```

Figure 2N-6

```
1840 I  S  A  N  D  F  L  G  S  L  E  L  Q  L  P  D  M  V  R  G
5581 CATCTCTGCCAATGACTTCCTTGGATCCCTGGAGTTGCAGCTACCAGACATGGTGCGTGG
1860 A  R  G  P  E  L  C  S  V  Q  L  A  R  N  G  A  G  P  R  C
5641 GGCCCGGGGCCCCGAGCTCTGCTCTGTGCAGCTGGCCCGCAATGGGGCCGGGCCGAGGTG
1880 N  L  F  R  C  R  R  L  R  G  W  W  P  V  V  K  L  K  E  A
5701 CAATCTGTTTCGCTGCCGCCGCCTGAGGGGCTGGTGGCCGGTAGTGAAGCTGAAGGAGGC
1900 E  D  V  E  R  E  A  Q  E  A  Q  A  G  K  K  K  R  K  Q  R
5761 AGAGGACGTGGAGCGGGAGGCGCAGGAGGCTCAGGCTGGCAAGAAGAAGCGAAAGCAGAG
1920 R  R  K  G  R  P  E  D  L  E  F  T  D  M  G  G  N  V  Y  I
5821 GAGGAGGAAGGGCCGGCCAGAAGACCTGGAGTTCACAGACATGGGTGGCAATGTGTACAT
1940 L  T  G  K  V  E  A  E  F  E  L  L  T  V  E  E  A  E  K  R
5881 CCTCACGGGCAAGGTGGAGGCAGAGTTTGAGCTGCTGACTGTGGAGGAGGCCGAGAAACG
1960 P  V  G  K  R  K  Q  P  E  P  L  E  K  P  S  R  P  K  T
5941 GCCAGTGGGGAAGGGGCGGAAGCAGCCAGAGCCTCTGGAGAAACCCAGCCGCCCCAAAAC
1980 S  F  N  W  F  V  N  P  L  K  T  F  V  F  F  I  W  R  R  Y
6001 TTCCTTCAACTGGTTTGTGAACCCGCTGAAGACCTTTGTCTTCTTCATCTGGCGCCGGTA
2000 W  R  T  L  V  L  L  L  L  V  L  L  T  V  F  L  L  L  V  F
6061 CTGGCGCACCCTGGTGCTGCTGCTACTGGTGCTGCTCACCGTCTTCCTCCTCCTGGTCTT
2020 Y  T  I  P  G  Q  I  S  Q  V  I  F  R  P  L  H  K  *
6121 CTACACCATCCCTGGCCAGATCAGCCAGGTCATCTTCCGTCCCCTCCACAAGTGActctc
6181 gctgaccttggacactcacccagggtgccaaccctccaatgcctgctcctggaagtcttt
6241 cttacccatgtgagctaccccagagtctagtgcttcctctgaataaacctatcacagcc
```

Figure 2O. The cDNA (SEQ ID NO:30) and amino acid sequence (SEQ ID NO:31) of 158P3D2 v.18.

```
  1 agaagaaagctggtaggggctgggagagggtaccacaggggagtatgatctacttgggg
 61 ccagagaaggttccctgaggaaatagtacctgaacttagacttgaaggataacagatgtt
121 aactgggaggagagaatgttccaggcagaggaaaaggcatatgcaaaagtccagcgcctt
181 gaaggagcacagctggggtgcctggagtgagatggagctggaaagatccaggtggagctt
241 gacctgaagtaccagcccccagagggcgctactggagcctggtcagaggaggactttggg
301 gcacccatccaggacagcttcgagttaatcatccccaatgtgggcttccaggaactggag
361 cctggggaggcccagctggagcggcgggcagtggctctaggccgcaggctagctcgaagt
421 ctaggccagcaggacgatgaagagaatgagctggagcttgagctggagcaggacctggat
481 gatgagcctgacgtggaactttctggtgttatgttcagcccctcaagagccgcgccagg
541 gccctggcccatggggatcccttccaggtgtccagagctcaagacttccaggtgggagtc
601 actgtgctggaagcccagaaactggtgggagtcaacattaaccctatgtggccgtgcaa
661 gtgggggggcagcgccgtgtgaccgccacacagcgtgggaccagttgcccccttctacaat
```

Figure 2O-2

```
 721 gagtacttcttgttcgaatttcatgacacgcggcttcgtctccaagacttgctgctggag
 781 atcacggtgagtggggtaggggtgaccagtgtccttcagagaaggggggatgagaaagct
 841 gcaggactaacaccaccttcccccaaggcttttccattcgcagaccctccccctttatggcc
 901 acccggataggcaccttcaggatggacctgggcatcatcttggaccagccaggtatggaa
 961 tcgtcccttattgagactctgcacggacaagggccctagagattgacctgcagtgact
1021 ccgcatggaccctatacactcacttcggagagggccatctctggcggaggctgaactct
1081 tggcacttccgcccctccctgctgagccagagaagccctggccattgtccgtcactccga
1141 tagcctcacggccaccctgtgcgtcccgccggtcgccccttaccctggctcgcccttc
1201 gcccttagatggccagttctaccaaagatgggttccgctgcatgatccccgagacacccg
1261 cgccgggaccaagggtttcattaaggtcaccttgtccgtgagggcgcgcggggacctgcc
1321 ccctccaatgctaccccggcccagggcactgttcggacatcgagaagtgagccgggt
1381 gaggtggggaggaggacatggatccggggtggccgtggggcgcggataaggggagggc
1441 cgagatcccagtttctccccccccgctcggtgcccctccctaggaacctgctcctgcc
1501 gcgcggggtgcccgccgagaggccatgggcgcggctccgcgtgcgcctgtaccgcgccga
1561 ggggcttcccgcgctgcgcctggggctgctgggcagcctggtccgcgccctgcacgacca
1621 gcgcgtcctggtggagccctatgtgcgggtgtctttcctggggcaggagggcgagacgtc
1681 ggtgagcgccgaggcggcggcgcccgaatggaacgagcagctgagcttcgtggagctctt
1741 cccgccgctgacgcgcagcctccgcctgcagctgcgggacgacgcgccctggtcgacgc
1801 ggcactcgctacgcacgtgccggacctgaggcggatctcccatccgggccgcgcggcggg
1861 gtttaaccctaccttcggcccggcctgggtgccctctatggctcgcccccggcgcggg
1921 gctccgggatagtcttcaaggtctcaacgaaggcgttggccaaggcatttggttccgcgg
1981 ccgccttctgctggctgtgtccatgcaggtgttggaagggagagctgaacctgagcctcc
2041 ccaggcccagcaggggtccacgttgtcccggctcacccgaaagaagaaaaagaaagccag
2101 aagggatcagacccccaaaggcggttccgcagcacttggacgccagccccggtgccgaggg
2161 gcctgagatccccgtgccatggaggtggaggtggaggagctgctgccgctgccagagaa
2221 tgtcctggcgccctgtgaagatttcctgcttttcggtgtgctcttcgaggccaccatgat
2281 cgaccccaccgtggcctcccagcccatcagcttcgagatctccattggtgtgtggcctag
2341 ccgaacccctgagtgccatttcagaccttagaaccctggaaggggtgttgactttcagtc
2401 gcgcaggccgtctggaggagcaattgggccgagggtccaggctggggagggaactgagg
2461 gtgcagccgtggaggctcagcctctgctgggagccaggccagaggaggagaaagaggagg
2521 aagaactggggacccatgctcagcggcctgagcccatggacggcagtgggccatacttct
2581 gcttgcccctctgtcactgcaagccatgcatgcatgtgtggagttgctgggaggaccaca
2641 cctggcgcctgcagagcagcaactgcgtgcgcaaagtggccgagaggctggaccaggggc
2701 tgcaggaggttgagagactgcagcgcaagccggggcctggcgcctgtgcacagctcaagc
2761 aggcactggaagtactggtggctgggagcagacagttttgccacggtgccgagcgcagga
2821 cgatgacccggcccaatgccctggatcgatgccgagggaaactcctggtgcacagcctga
```
```
   1                                                          M  C  K
2881 accttttggctaagcaaggactgcgacttctacgcggcctgagacggcgcaATGTGCAAA
   4 R  R  W  H  W  P  R  S  S  W  Q  N  C  A  F  W  L  R  R  H
```

Figure 2O-3

```
2941 AGAAGGTGGCACTGGCCAAGAAGCTCCTGGCAAAACTGCGCTTTCTGGCTGAGGAGGCAC
  24 P  G  Q  P  L  V  R  S  V  P  S  W  S  S  C  G  W  A  W
3001 CCGGGGCAGCCCCTGGTGAGGTCTGTGCCAAGCTGGAGCTCTTCCTGCGGCTGGGCCTGG
  44 A  S  K  P  R  P  A  P  L  S  C  P  R  I  C  C  P  S  P  Q
3061 GCAAGCAAGCCAAGGCCTGCACCTCTGAGCTGCCCCCGGATTTGCTGCCCGAGCCCTCAG
  64 P  G  C  P  P  A  Y  T  G  T  V  L  E  Q  T  L  S  P  L  W
3121 CCGGGCTGCCCTCCAGCCTACACCGGGACGGTCCTGGAGCAGACGCTGAGCCCTCTGTGG
  84 D  E  L  L  V  F  E  Q  L  I  V  D  G  R  R  E  H  L  Q  E
3181 GATGAACTCCTGGTATTTGAGCAGTTGATCGTGGATGGGAGGAGGGAGCACCTGCAGGAG
 104 E  P  P  L  V  I  I  N  V  F  D  H  N  K  F  G  P  P  V  F
3241 GAGCCTCCATTAGTGATCATCAATGTATTTGACCACAATAAGTTTGGCCCCCCCGTGTTC
 124 L  G  R  A  L  A  A  P  R  V  K  L  M  E  D  P  Y  Q  R  P
3301 CTGGGCAGGGCACTGGCCGCCCCAAGGGTAAAGCTGATGGAGGACCCATACCAACGCCCA
 144 E  L  Q  F  F  P  L  R  K  G  P  W  A  A  G  E  L  I  A  A
3361 GAGTTGCAGTTCTTCCCCCTGAGGAAGGGACCCTGGGCAGCCGGAGAGCTCATTGCCGCC
 164 F  Q  L  I  E  L  D  Y  S  G  R  L  E  P  S  V  P  S  E  V
3421 TTTCAACTCATTGAACTAGACTACAGTGGCCGACTTGAGCCCTCAGTGCCCAGTGAGGTG
 184 E  P  Q  D  L  A  P  L  V  E  P  H  S  G  R  L  S  L  P  P
3481 GAGCCCCAGGATCTGGCACCCCTGGTTGAGCCCCACTCTGGACGCCTGTCCCTTCCACCC
 204 N  V  C  P  V  L  R  E  F  R  V  E  V  L  F  W  G  L  R  G
3541 AACGTGTGCCCAGTGCTCAGGGAGTTCCGTGTTGAGGTGCTGTTCTGGGGTCTTAGGGGA
 224 L  G  R  V  H  L  L  E  V  E  Q  P  Q  V  V  L  E  V  A  G
3601 CTTGGTCGTGTGCATCTGCTCGAGGTGGAGCAGCCCCAGGTTGTACTGGAGGTGGCTGGG
 244 Q  G  V  E  S  E  V  L  A  S  Y  R  E  S  P  N  F  T  E  L
3661 CAAGGTGTGGAGTCTGAGGTCCTGGCCAGCTACCGTGAGAGCCCCAATTTCACTGAGCTT
 264 V  R  H  L  T  V  V  F  K  D  T  A  P  L  F  H  P  Q  D  L
3721 GTCAGGCATCTGACAGTGGTCTTCAAAGACACAGCTCCTCTCTTCCACCCCCAGGACTTG
 284 P  E  Q  P  Y  L  Q  P  P  L  S  I  L  V  I  E  R  R  A  F
3781 CCGGAGCAGCCTTACTTGCAGCCTCCACTCAGCATCTTGGTGATTGAGCGCCGGGCCTTT
 304 G  H  T  V  L  V  G  S  H  I  V  P  H  M  L  R  F  T  F  R
3841 GGCCACACAGTCCTTGTGGGTTCCCACATTGTCCCCCACATGCTGCGATTCACATTTCGG
 324 G  H  E  D  P  P  E  E  E  G  E  M  E  E  T  G  D  M  M  P
3901 GGTCATGAGGATCCTCCTGAGGAGGAAGGAGAGATGGAGGAGACAGGGGATATGATGCCC
 344 K  G  P  Q  G  Q  K  S  L  D  P  F  L  A  E  A  G  I  S  R
3961 AAGGGACCTCAAGGACAGAAGTCCCTGGATCCCTTCTTGGCTGAAGCGGGTATATCCAGA
 364 Q  L  L  K  H  N  F  D  E  D  E  M  D  D  P  G  D  S  D  G
4021 CAGCTCCTGAAGCACAACTTTGATGAAGATGAAATGGATGATCCTGGAGATTCAGATGGG
 384 V  N  L  I  S  M  V  G  E  I  Q  D  Q  G  E  A  E  V  K  G
4081 GTCAACCTCATTTCTATGGTTGGGGAGATCCAAGACCAGGGTGAGGCTGAAGTCAAAGGC
```

Figure 2O-4

```
 404 T  V  S  P  K  K  A  V  A  T  L  K  I  Y  N  R  S  L  K  E
4141 ACTGTGTCCCCAAAAAAAGCAGTTGCCACCCTGAAGATCTACAACAGGTCCCTGAAGGAA
 424 E  F  N  H  F  E  D  W  L  N  V  F  P  L  Y  R  G  Q  G  G
4201 GAATTTAACCACTTTGAAGACTGGCTGAATGTGTTTCCTCTGTACCGAGGGCAAGGGGGC
 444 Q  D  G  G  G  E  E  E  G  S  G  H  L  V  G  K  F  K  G  S
4261 CAGGATGGAGGTGGAGAAGAGGAAGGATCTGGACACCTTGTGGGCAAGTTCAAGGGCTCC
 464 F  L  I  Y  P  E  S  E  A  V  L  F  S  E  P  Q  I  S  R  G
4321 TTCCTCATTTACCCTGAATCAGAGGCAGTGTTGTTCTCTGAGCCCCAGATCTCCCGGGGG
 484 I  P  Q  N  R  P  I  K  L  L  V  R  V  Y  V  V  K  A  T  N
4381 ATCCCACAGAACCGGCCCATCAAGCTCCTGGTCAGAGTGTATGTTGTAAAGGCTACCAAC
 504 L  A  P  A  D  P  N  G  K  A  D  P  Y  V  V  V  S  A  G  R
4441 CTGGCTCCTGCAGACCCCAATGGCAAAGCAGACCCTTACCTGGTCGTGAGCGCTGGCCGG
 524 E  R  Q  D  T  K  E  R  Y  I  P  K  Q  L  N  P  I  F  G  E
4501 GAGCGGCAGGACACCAAGGAACGCTACATCCCCAAGCAGCTCAACCCCATCTTTGGAGAG
 544 I  L  E  L  S  I  S  L  P  A  E  T  E  L  T  V  A  V  F  D
4561 ATCCTGGAGCTAAGCATCTCTCTCCCAGCTGAGACGGAGCTGACGGTCGCCGTATTTGAT
 564 H  D  L  V  G  S  D  D  L  I  G  E  T  H  I  D  L  E  N  R
4621 CATGACCTCGTGGGTTCTGACGACCTCATCGGGGAGACCCACATTGATCTGGAAAACCGA
 584 F  Y  S  H  H  R  A  N  C  G  L  A  S  Q  Y  E  V  W  V  Q
4681 TTCTATAGCCACCACAGAGCAAACTGTGGGCTGGCCTCCCAGTATGAAGTGTGGGTCCAG
 604 Q  G  P  Q  E  P  F  *
4741 CAGGGCCCACAGGAGCCATTCTGAgtttctggccaaacacattcaagctcacattcccttt
4801 ttgtgtctccagatcctatgatttcatggaaggggaccctcccacccaccgccactgcca
4861 accaagacatagctcagtggtcaagacttgggcttgggagtcgggatcctgtaacgaatg
4921 tcacttgaccgctttcttttttttatgaaacagtctcgctctgtctcccaggttggagtgc
4981 agtggcacgatctcggctgactgcaacctccacctcctgggttcaagcgattctcctgcc
5041 tcagcctccccagtagctgggattacaggcgtgggccccatgtccagctaattttttata
5101 ttttcgctctgtctcccaggttggagtgcagtggcacgatctcggctgactgcaacctcc
5161 acctcctgggttcaagcgattctcctgcctcagcctccccagtagctgggattacaggcg
5221 tgggccccatgtccagctaattttttatattttagtagagacagggtttcaccatgttg
5281 tccaggctggtcttgaaccctgacctcaagtgatccacccacctctgcctcccaaagtg
5341 ctgggattacaggtgtgagccaccatgccaggccctcttaacctcttcaagtctgttttc
5401 tcatctgcaaaacagaggtaataagatcagtatcttcttaatggaagcacctggactaca
5461 tttttttcattcattgttatcataaatgaggactaacctgtctcccgttgggagttttga
5521 acctagacctcatgtcttcatgacgtcatcactgccccaggcccagctgtgtccctacac
5581 cagcccagctgacgcatcttcttttttctgcctgtagagatggttacaatgcctggcgtg
5641 atgcattctggccttcgcagatcctggcggggctgtgccaacgctgtggcctccctgccc
5701 ctgaataccgagccggtgctgtcaaggtgggcagcaaagtcttcctgacaccaccggaga
5761 ccctgccccagggatctcttcacatgtggattgacatctttcctcaagatgtgcctgct
```

Figure 2O-5

```
5821 ccaccccagttgacatcaagcctcggcagccaatcagctatgagctcagagttgtcatc
5881 tggaacacggaggatgtggttctggatgacgagaatccactcaccggagagatgtcgagt
5941 gacatctatgtgaagagctggctgaagggagttggagcatgacaagcaggagacagacgtt
6001 cacttcaactccctgactggggaggggaacttcaattggcgctttgtgttccgctttgac
6061 tacctgcccacggagcgggaggtgagcgtctggcgcaggtctggacccttttgccctggag
6121 gaggcggagttccggcagcctgcagtgctggtcctgcaggatcctggagttgcagctac
6181 cagacatggtgcgtggggcccgggccccgagctctgctctgtgcagctggccgcaatg
6241 gggccgggccgaggtgcaatctgtttcgctgccgccgcctgaggggctggtggccggtag
6301 tgaagctgaaggaggcagaggacgtggagcgggagcgcaggaggctcaggctggcaaga
6361 agaagcgaaagcagaggaggaggaagggccggccagaagacctggagttcacagacatgg
6421 gtggcaatgtgtacatcctcacgggcaaggtggaggcagagtttgagctgctgactgtgg
6481 aggaggccgagaaacggccagtggggaagggcggaagcagccagagcctctggagaaac
6541 ccagccgccccaaaacttccttcaactggtttgtgaacccgctgaagacctttgtcttct
6601 tcatctggcgccggtactggcgcaccctggtgctgctgctactggtgctgctcaccgtct
6661 tcctcctcctggtcttctacaccatccctggccagatcagccaggtcatcttccgtcccc
6721 tccacaagtgactctcgctgaccttggacactcacccagggtgccaaccttcaatgcct
6781 gctcctggaagtctttcttacccatgtgagctacccagagtctagtgcttcctctgaat
6841 aaacctatcacagcc
```

Figure 2P. The cDNA (SEQ ID NO:32) and amino acid sequence (SEQ ID NO:33) of 158P3D2 v.19.

```
  1 caggtgggcgggctggtgggcagaagggcagacgggcagaggaagtgccagtgccactgg
  1   M  A  L  T  V  S  V  Q  R  L  T  G  L  T  G  T  H  D  R
 61 gaccATGGCTCTCACCGTAAGCGTGCAACCACTAACAGGGCTGACCGGCACCCACGACCG
 20   Q  V  K  L  T  F  R  G  F  T  Q  K  T  R  K  I  H  C  P
121 ACAAGTGAAGCTCACCTTTCGAGGCTTTACCCAGAAAACAAGAAAAATTCACTGTGGTCC
 40   E  A  D  I  G  E  L  F  R  W  P  H  Y  G  A  P  L  A  G
181 AGAAGCAGATATCGGTGAGCTGTTCCGATGGCCCCACTATGGGGCTCCACTGGCTGGGGA
 60   C  L  S  V  Q  V  V  N  C  S  R  V  F  S  L  R  P  L  G  T
241 GTGTCTGTCTGTGCAGGTGGTCAACTGCAGCCGTGTATTCAGCCTTAGGCCTCTAGGGAC
 80   L  V  I  S  L  Q  Q  L  Q  N  A  G  H  L  V  L  R  E  A  L
301 CCTGGTGATCTCCCTGCAGCAGCTACAGAATGCTGGGCATTTGGTGCTACGGGAAGCCCT
100   V  D  E  N  L  Q  V  S  P  I  Q  V  E  L  D  L  K  Y  Q  P
361 AGTGGATGAGAATCTTCAAGTGTCCCCGATCCAGGTGGAGCTTGACCTGAAGTACCAGCC
120   P  E  G  A  T  G  A  W  S  E  D  F  G  A  P  I  Q  D  S
421 CCCAGAGGGCGCTACTGGAGCCTCGTCAGAGGAGGACTTTCGGCCACCCATCCAGGACAG
140   F  E  L  I  I  P  N  V  G  F  Q  E  L  E  P  G  E  A  Q  L
```

Figure 2P-2

```
 481 CTTCGAGTTAATCATCCCCAATGTGGGCTTCCAGGAACTGGAGCCTGGGGAGGCCCAGCT
 160   E  R  R  A  V  A  L  G  R  R  L  A  R  S  L  G  Q  Q  D  D
 541 GGAGCGGCGGGCAGTGGCTCTAGGCCGCAGGCTAGCTCGAAGTCTAGGCCAGCAGGACGA
 180   E  E  N  E  L  E  L  E  Q  D  L  D  D  E  P  D  V  E
 601 TGAAGAGAATGAGCTGGAGCTTGAGCTGGAGCAGGACCTGGATGATGAGCCTGACGTGGA
 200   L  S  G  V  M  F  S  P  L  K  S  R  A  R  A  L  A  H  G  D
 661 ACTTTCTGGTGTTATGTTCAGCCCCCTCAAGAGCCGCGCCAGGGCCCTGGCCCATGGGGA
 220   P  F  Q  V  S  R  A  Q  D  F  Q  V  G  V  T  V  L  E  A  Q
 721 TCCCTTCCAGGTGTCCAGAGCTCAAGACTTCCAGGTGGGAGTCACTGTGCTGGAAGCCCA
 240   K  L  V  G  V  N  I  N  P  Y  V  A  V  Q  V  G  G  Q  R  R
 781 GAAACTGGTGGGAGTCAACATTAACCCCTATGTGGCCGTGCAAGTGGGGGGGCAGCGCCG
 260   V  T  A  T  Q  R  G  T  S  C  P  F  Y  N  E  Y  F  L  F  E
 841 TGTGACCGCCACACAGCGTGGGACCAGTTGCCCCTTCTACAATGAGTACTTCTTGTTCGA
 280   F  H  D  T  R  L  R  L  Q  D  L  L  E  I  T  V  S  G  V
 901 ATTTCATGACACGCGGCTTCGTCTCCAAGACTTGCTGCTGGAGATCACGGTGAGTGGGGT
 300   G  V  T  S  V  L  Q  R  R  G  D  E  K  A  A  G  L  T  P  P
 961 AGGGGTGACCAGTGTCCTTCAGAGAAGGGGGGATGAGAAAGCTGCAGGACTAACACCACC
 320   S  P  K  A  F  H  S  Q  T  L  P  F  M  A  T  R  I  G  T  F
1021 TTCCCCCAAGGCTTTCCATTCGCAGACCCTCCCCTTTATGGCCACCCGGATAGGCACCTT
 340   R  M  D  L  G  I  I  L  D  Q  P  D  G  Q  F  Y  Q  R  W  V
1081 CAGGATGGACCTGGGCATCATCTTGGACCAGCCAGATGGCCAGTTCTACCAAAGATGGGT
 360   P  L  H  D  P  R  D  T  R  A  G  T  K  G  F  I  K  V  T  L
1141 TCCGCTGCATGATCCCCGAGACACCCGCGCCGGGACCAAGGGTTTCATTAAGGTCACCTT
 380   S  V  R  A  R  G  D  L  P  P  P  M  L  P  P  A  P  G  H  C
1201 GTCCGTGAGGGCGCGCGGGGACCTGCCCCCTCCAATGCTACCCCCGGCCCCAGGGCACTG
 400   S  D  I  E  K  N  L  L  L  P  R  G  V  P  A  E  R  P  W  A
1261 TTCGGACATCGAGAAGAACCTGCTCCTGCCGCGCGGGGTGCCCGCCGAGAGGCCATGGGC
 420   R  L  R  V  R  L  Y  R  A  E  G  L  P  A  L  R  L  G  L  L
1321 GCGGCTCCGCGTGCGCCTGTACCGCGCCGAGGGGCTTCCCGCGCTGCGCCTGGGGCTGCT
 440   G  S  L  V  R  A  L  H  D  Q  R  V  L  V  E  P  Y  V  R  V
1381 GGGCAGCCTGGTCCGCGCCCTGCACGACCAGCGCGTCCTGGTGGAGCCCTATGTGCGGGT
 460   S  F  L  G  Q  E  G  E  T  S  V  S  A  E  A  A  A  P  E  W
1441 GTCTTTCCTGGGCAGGAGGGCGAGACGTCGGTGAGCGCCGAGGCGGCGGCGCCCGAATG
 480   N  E  Q  L  S  F  V  E  L  F  P  P  L  T  R  S  L  R  L  Q
1501 GAACGAGCAGCTGAGCTTCGTGGAGCTCTTCCCGCCGCTGACGCGCAGCCTCCGCCTGCA
 500   L  R  D  D  A  P  L  V  D  A  A  L  A  T  H  V  P  D  L  R
1561 GCTGCGGGACGACGCGCCCCTGGTCGACGCGGCACTCGCTACGCACGTGCCGGACCTGAG
 520   R  I  S  H  P  G  R  A  A  G  F  N  P  T  F  G  P  A  W  V
1621 GCGGATCTCCCATCCGGGCCGCGCGGCGGGGTTTAACCCTACCTTCGGCCCGGCCTGGGT
```

Figure 2P-3

```
 540  P  L  Y  G  S  P  P  G  A  G  L  R  D  S  L  Q  G  L  N  E
1681  GCCCCTCTATGGCTCGCCCCCGGCGCGGGGCTCCGGGATAGTCTTCAAGGTCTCAACGA
 560  G  V  G  Q  G  I  W  F  R  G  R  L  L  L  A  V  S  M  Q  V
1741  AGGCGTTGGCCAAGGCATTTGGTTCCGCGGCCGCCTTCTGCTGGCTGTGTCCATGCAGGT
 580  L  E  G  R  A  E  P  E  P  P  Q  A  Q  Q  G  S  T  L  S  R
1801  GTTGGAAGGAGAGCTGAACCTGAGCCTCCCCAGGCCCAGCAGGGGTCCACGTTGTCCCG
 600  L  T  R  K  K  K  K  A  R  R  D  Q  T  P  K  A  V  P  Q
1861  GCTCACCCGAAAGAAGAAAAAGAAAGCCAGAAGGGATCAGACCCCAAAGGCGGTTCCGCA
 620  H  L  D  A  S  P  G  A  E  G  P  E  I  P  R  A  M  E  V  E
1921  GCACTTGGACGCCAGCCCCGGTGCCGAGGGGCCTGAGATCCCCCGTGCCATGGAGGTGGA
 640  V  E  E  L  L  P  L  P  E  N  V  L  A  P  C  E  D  F  L  L
1981  GGTGGAGGAGCTGCTGCCGCTGCCAGAGAATGTCCTGGCGCCCTGTGAAGATTTCCTGCT
 660  F  G  V  L  F  E  A  T  M  I  D  P  T  V  A  S  Q  P  I  S
2041  TTTCGGTGTGCTCTTCGAGGCCACCATGATCGACCCCACCGTGGCCTCCCAGCCCATCAG
 680  F  E  I  S  I  G  R  A  G  R  L  E  E  Q  L  G  R  G  S  R
2101  CTTCGAGATCTCCATTGGTCGCGCAGGCCGTCTGGAGGAGCAATTGGGCCGAGGGTCCAG
 700  A  G  E  G  T  E  G  A  A  V  E  A  Q  P  L  L  G  A  R  P
2161  GGCTGGGGAGGGAACTGAGGGTGCAGCCGTGGAGGCTCAGCCTCTGCTGGGAGCCAGGCC
 720  E  E  E  K  E  E  E  E  L  G  T  H  A  Q  R  P  E  P  M  D
2221  AGAGGAGGAGAAAGAGGAGGAAGAACTGGGGACCCATGCTCAGCGGCCTGAGCCCATGGA
 740  G  S  G  P  Y  F  C  L  P  L  C  H  C  K  P  C  M  H  V  W
2281  CGGCAGTGGGCCATACTTCTGCTTGCCCCTCTGTCACTGCAAGCCATGCATGCATGTGTG
 760  S  C  W  E  D  H  T  W  R  L  Q  S  S  N  C  V  R  K  V  A
2341  GAGTTGCTGGGAGGACCACACCTGGCGCCTGCAGAGCAGCAACTGCGTGCGCAAAGTGGC
 780  E  R  L  D  Q  G  L  Q  E  V  E  R  L  Q  R  K  P  G  P  G
2401  CGAGAGGCTGGACCAGGGGCTGCAGGAGGTTGAGAGACTGCAGCGCAAGCCGGGGCCTGG
 800  A  C  A  Q  L  K  Q  A  L  E  V  L  V  A  G  S  R  Q  F  C
2461  CGCCTGTGCACAGCTCAAGCAGGCACTGGAAGTACTGGTGGCTGGGAGCAGACAGTTTTG
 820  H  G  A  E  R  R  T  M  T  R  P  N  A  L  D  R  C  R  G  K
2521  CCACGGTGCCGAGCGCAGGACGATGACCCGGCCCAATGCCCTGGATCGATGCCGAGGGAA
 840  L  L  V  H  S  L  N  L  L  A  K  Q  G  L  R  L  L  R  G  L
2581  ACTCCTGGTGCACAGCCTGAACCTTTTGGCTAAGCAAGGACTGCGACTTCTACGCGGCCT
 860  R  R  R  N  V  Q  K  K  V  A  L  A  K  K  L  L  A  K  L  R
2641  GAGACGGCGCAATGTGCAAAAGAAGGTGGCACTGGCCAAGAAGCTCCTGGCAAAACTGCG
 880  F  L  A  E  E  P  Q  P  P  L  P  D  V  L  V  W  M  L  S  G
2701  CTTTCTGGCTGAGGAGCCCCAGCCACCCCTCCCCGATGTGCTGGTCTGGATGCTCAGCGG
 900  Q  R  R  V  A  W  A  R  I  P  A  Q  D  V  L  F  S  V  V  E
2761  GCAGCGCCGTGTGGCCTGGGCCCGGATCCCTGCCCAGGATGTGCTGTTCTCTGTGGTTGA
 920  E  E  R  G  R  D  C  G  K  I  Q  S  L  M  L  T  A  P  G  A
```

Figure 2P-4

```
2821 GGAGGAACGGGGCCGAGACTGTGGGAAGATCCAGAGTCTAATGCTCACGGCACCCGGGGC
 940  A  P  G  E  V  C  A  K  L  E  L  F  L  R  L  G  L  G  K  Q
2881 AGCCCCTGGTGAGGTCTGTGCCAAGCTGGAGCTCTTCCTGCGGCTGGGCCTGGGCAAGCA
 960  A  K  A  C  T  S  E  L  P  P  D  L  L  P  E  P  S  A  G  L
2941 AGCCAAGGCCTGCACCTCTGAGCTGCCCCCGGATTTGCTGCCCGAGCCCTCAGCCGGGCT
 980  P  S  S  L  H  R  D  D  F  S  Y  F  Q  L  R  A  H  L  Y  Q
3001 GCCCTCCAGCCTACACCGGGACGACTTTAGCTACTTCCAACTCCGGGCTCACTTGTACCA
1000  A  R  G  V  L  A  A  D  D  S  G  L  S  D  P  F  A  R  V  L
3061 GGCCCGGGGTGTGTTGGCTGCAGATGACAGTGGCCTCTCGGACCCCTTTGCTCGAGTCCT
1020  I  S  T  Q  C  Q  T  T  R  V  L  E  Q  T  L  S  P  L  W  D
3121 CATCTCTACCCAGTGTCAGACCACACGGGTCCTGGAGCAGACGCTGAGCCCTCTGTGGGA
1040  E  L  L  V  F  E  Q  L  I  V  D  G  R  R  E  H  L  Q  E  E
3181 TGAACTCCTGGTATTTGAGCAGTTGATCGTGGATGGGAGGAGGGAGCACCTGCAGGAGGA
1060  P  P  L  V  I  I  N  V  F  D  H  N  K  F  G  P  P  V  F  L
3241 GCCTCCATTAGTGATCATCAATGTATTTGACCACAATAAGTTTGGCCCCCCCGTGTTCCT
1080  G  R  A  L  A  A  P  R  V  K  L  M  E  D  P  Y  Q  R  P  E
3301 GGGCAGGGCACTGGCCGCCCCAAGGGTAAAGCTGATGGAGGACCCATACCAACGCCCAGA
1100  L  Q  F  F  P  L  R  K  G  P  W  A  A  G  E  L  I  A  A  F
3361 GTTGCAGTTCTTCCCCCTGAGGAAGGGACCCTGGGCAGCCGGAGAGCTCATTGCCGCCTT
1120  Q  L  I  E  L  D  Y  S  G  R  L  E  P  S  V  P  S  E  V  E
3421 TCAACTCATTGAACTAGACTACAGTGGCCGACTTGAGCCCTCAGTGCCCAGTGAGGTGGA
1140  P  Q  D  L  A  P  L  V  E  P  H  S  G  R  L  S  L  P  P  N
3481 GCCCCAGGATCTGGCACCCCTGGTTGAGCCCCACTCTGGACGCCTGTCCCTTCCACCCAA
1160  V  C  P  V  L  R  E  F  R  V  E  V  L  F  W  G  L  R  G  L
3541 CGTGTGCCCAGTGCTCAGGGAGTTCCGTGTTGAGGTGCTGTTCTGGGGTCTTAGGGGACT
1180  G  R  V  H  L  L  E  V  E  Q  P  Q  V  V  L  E  V  A  G  Q
3601 TGGTCGTGTGCATCTGCTCGAGGTGGAGCAGCCCCAGGTTGTACTGGAGGTGGCTGGGCA
1200  G  V  E  S  E  V  L  A  S  Y  R  E  S  P  N  F  T  E  L  V
3661 AGGTGTGGAGTCTGAGGTCCTGGCCAGCTACCGTGAGAGCCCCAATTTCACTGAGCTTGT
1220  R  H  L  T  V  D  L  P  E  Q  P  Y  L  Q  P  P  L  S  I  L
3721 CAGGCATCTGACAGTGGACTTGCCGGAGCAGCCTTACTTGCAGCCTCCACTCAGCATCTT
1240  V  I  E  R  R  A  F  G  H  T  V  L  V  G  S  H  I  V  P  H
3781 GGTGATTGAGCGCCGGGCCTTTGGCCACACAGTCCTTGTGGGTTCCCACATTGTCCCCCA
1260  M  L  R  F  T  F  R  G  H  E  D  P  P  E  E  E  G  E  M  E
3841 CATGCTGCGATTCACATTTCGGGGTCATGAGGATCCTCCTGAGGAGGAAGGAGAGATGGA
1280  E  T  G  D  M  M  P  K  G  P  Q  G  Q  K  S  L  D  P  F  L
3901 GGAGACAGGGGATATGATGCCCAAGGGACCTCAAGGACAGAAGTCCCTGGATCCCTTCTT
1300  A  E  A  G  I  S  R  Q  L  L  K  P  P  L  K  K  L  P  L  G
3961 GGCTGAAGCGGGTATATCCAGACAGCTCCTGAAGCCTCCTCTGAAGAAGCTCCCACTAGG
```

Figure 2P-5

```
1320  G  L  L  N  Q  G  P  G  L  E  E  D  I  P  D  P  E  E  L  D
4021 AGGCCTCCTAAATCAAGGCCCTGGGCTGGAGGAAGACATCCCAGATCCAGAGGAGCTCGA
1340  W  G  S  K  Y  Y  A  S  L  Q  E  L  Q  G  Q  H  N  F  D  E
4081 CTGGGGGTCCAAGTACTATGCGTCCCTGCAGGAGCTCCAGGGGCAGCACAACTTTGATGA
1360  D  E  M  D  D  P  G  D  S  D  G  V  N  L  I  S  M  V  G  E
4141 AGATGAAATGGATGATCCTGGAGATTCAGATGGGGTCAACCTCATTTCTATGGTTGGGGA
1380  I  Q  D  Q  G  E  A  E  V  K  C  T  V  S  P  K  K  A  V  A
4201 GATCCAAGACCAGGGTGAGGCTGAAGTCAAAGGCACTGTGTCCCAAAAAAAGCAGTTGC
1400  T  L  K  I  Y  N  R  S  L  E  E  E  F  N  H  F  E  D  W  L
4261 CACCCTGAAGATCTACAACAGGTCCCTGGAGGAAGAATTTAACCACTTTGAAGACTGGCT
1420  N  V  F  P  L  Y  R  G  Q  G  G  Q  D  G  G  E  E  E  G
4321 GAATGTGTTTCCTCTGTACCGAGGGCAAGGGGGCCAGGATGGAGGTGGAGAAGAGGAAGG
1440  S  G  H  L  V  G  K  F  K  G  S  F  L  I  Y  P  E  S  E  A
4381 ATCTGGACACCTTGTGGGCAAGTTCAAGGGCTCCTTCCTCATTTACCCTGAATCAGAGGC
1460  V  L  F  S  E  P  Q  I  S  R  G  I  P  Q  N  R  P  I  K  L
4441 AGTGTTGTTCTCTGAGCCCCAGATCTCCCGGGGGATCCCACAGAACCGGCCCATCAAGCT
1480  L  V  R  V  Y  V  V  K  A  T  N  L  A  P  A  D  P  N  G  K
4501 CCTGGTCAGAGTGTATGTTGTAAAGGCTACCAACCTGGCTCCTGCAGACCCCAATGGCAA
1500  A  D  P  Y  V  V  V  S  A  G  R  E  R  Q  D  T  K  E  R  Y
4561 AGCAGACCCTTACGTGGTGGTGAGCGCTGGCCGGGAGCGGCAGGACACCAAGGAACGCTA
1520  T  P  K  Q  L  N  P  T  F  G  E  T  L  E  L  S  T  S  L  P
4621 CATCCCCAAGCAGCTCAACCCCATCTTTGGAGAGATCCTGGAGCTAAGCATCTCTCTCCC
1540  A  E  T  E  L  T  V  A  V  F  D  H  D  L  V  G  S  D  D  L
4681 AGCTGAGACGGAGCTGACGGTCGCCGTATTTGATCATGACCTCGTGGGTTCTGACGACCT
1560  I  G  E  T  H  I  D  L  E  N  R  F  Y  S  H  H  R  A  N  C
4741 CATCGGGGAGACCCACATTGATCTGGAAAACCGATTCTATAGCCACCACAGAGCAAACTG
1580  G  L  A  S  Q  Y  E  V  D  G  Y  N  A  W  R  D  A  F  W  P
4801 TGGGCTGGCCTCCCAGTATGAAGTAGATGGTTACAATGCCTGGCGTGATGCATTCTGGCC
1600  S  Q  I  L  A  G  L  C  Q  R  C  G  L  P  A  P  E  Y  R  A
4861 TTCGCAGATCCTGGCGGGGCTGTGCCAACGCTGTGGCCTCCCTGCCCCTGAATACCGAGC
1620  G  A  V  K  V  G  S  K  V  F  L  T  P  P  E  T  L  P  P  V
4921 CGGTGCTGTCAAGGTGGGCAGCAAAGTCTTCCTGACACCACCGGAGACCCTGCCCCCAGT
1640  A  S  G  D  P  E  E  A  Q  A  L  L  V  L  R  R  W  Q  E  M
4981 GGCGAGCGGGGACCCTGAAGAGGCCCAGGCATTGCTTGTGCTGCGGCGCTGGCAGGAAAT
1660  P  G  F  G  I  Q  L  V  P  E  H  V  E  T  R  P  L  Y  P
5041 GCCGGGTTTTGGGATCCAGCTGGTACCCGAGCATGTAGAAACCAGGCCTCTCTACCATCC
1680  H  S  P  G  L  L  Q  G  S  L  H  M  W  I  D  I  F  P  Q  D
5101 CCACAGCCCAGGGCTGCTACAGGGATCTCTTCACATGTGGATTGACATCTTTCCTCAAGA
1700  V  P  A  P  P  P  V  D  I  K  P  R  Q  P  I  S  Y  E  L  R
```

Figure 2P-6

```
5161 TGTGCCTGCTCCACCCCCAGTTGACATCAAGCCTCGGCAGCCAATCAGCTATGAGCTCAG
1720  V  V  I  W  N  T  E  D  V  V  L  D  D  E  N  P  L  T  G  E
5221 AGTTGTCATCTGGAACACGGAGGATGTGGTTCTGGATGACGAGAATCCACTCACCGGAGA
1740  M  S  S  D  I  Y  V  K  S  W  V  K  G  L  E  H  D  K  Q  E
5281 GATGTCGAGTGACATCTATGTGAAGAGCTGGGTGAAGGGGTTGGAGCATGACAAGCAGGA
1760  T  D  V  H  F  N  S  L  T  G  E  G  N  F  N  W  R  F  V  F
5341 GACAGACGTTCACTTCAACTCCCTGACTGGGGAGGGGAACTTCAATTGGCGCTTTGTGTT
1780  R  F  D  Y  L  P  T  E  R  E  V  S  V  W  R  R  S  G  P  F
5401 CCGCTTTGACTACCTGCCCACGGAGCGGGAGGTGAGCGTCTGGCGCAGGTCTGGACCCTT
1800  A  L  E  E  A  E  F  R  Q  P  A  V  L  V  L  Q  V  W  D  Y
5461 TGCCCTGGAGGAGGCGGAGTTCCGGCAGCCTGCAGTGCTGGTCCTGCAGGTCTGGGACTA
1820  D  R  I  S  A  N  D  F  L  G  S  L  E  Q  L  P  D  M  V
5521 TGACCGCATCTCTGCCAATGACTTCCTTGGATCCCTGGAGTTGCAGCTACCAGACATGGT
1840  R  G  A  R  G  P  E  L  C  S  V  Q  L  A  R  N  G  A  P
5581 GCGTGGGGCCCGGGGCCCCGAGCTCTGCTCTGTGCAGCTGGCCCGCAATGGGGCCGGGCC
1860  R  C  N  L  F  R  C  R  R  L  R  G  W  W  P  V  V  K  L  K
5641 GAGGTGCAATCTGTTTCGCTGCCGCCGCCTGAGGGGCTGGTGGCCGGTAGTGAAGCTGAA
1880  E  A  E  D  G  K  V  F  A  E  F  L  L  T  V  E  E  A  E
5701 GGAGGCAGAGGACGGCAAGGTGGAGGCAGAGTTTGAGCTGCTGACTGTGGAGGAGGCCGA
1900  K  R  P  V  G  K  G  R  K  Q  P  E  P  L  E  K  P  S  R  P
5761 GAAACGGCCAGTGGGGAAGGGGCGGAAGCAGCCAGAGCCTCTGGAGAAACCCAGCCGCCC
1920  K  T  S  F  N  W  F  V  N  P  L  K  T  F  V  F  F  I  W  R
5821 CAAAACTTCCTTCAACTGGTTTGTGAACCCGCTGAAGACCTTTGTCTTCTTCATCTGGCG
1940  R  Y  W  R  T  L  V  L  L  L  V  L  L  T  V  F  L  L
5881 CCGGTACTGGCGCACCCTGGTGCTGCTGCTACTGGTGCTGCTCACCGTCTTCCTCCTCCT
1960  V  F  Y  T  I  P  G  Q  I  S  Q  V  I  F  R  P  L  H  K  *
5941 GGTCTTCTACACCATCCCTGGCCAGATCAGCCAGGTCATCTTCCGTCCCCTCCACAAGTG
6001 Actctcgctgaccttggacactcacccagggtgccaaccctttcaatgcctgctcctggaa
6061 gtctttcttacccatgtgagctacccagagtctagtgcttcctctgaataaacctatca
6121 cagcc
```

Figure 2Q. The cDNA (SEQ ID NO:34) and amino acid sequence (SEQ ID NO:35) of 158P3D2 v.20.

```
  1 caggtgggcgggctggtgggcagaagggcagacgggcagaggaagtgccagtgccactgg
  1     M  A  L  T  V  S  V  Q  R  L  T  G  L  T  G  T  H  D  R
 61 gaccATGGCTCTGACGGTAAGCGTGCAACGACTAACAGGGCTGACCGGCACCCACGACCG
 20  Q  V  K  L  T  F  R  G  F  T  Q  K  T  R  K  I  H  C  G  P
```

Figure 2Q-2

```
 121 ACAAGTGAAGCTCACCTTTCGAGGCTTTACCCAGAAAACAAGAAAAATTCACTGTGTCC
  40   E  A  D  I  G  E  L  F  R  W  P  H  Y  G  A  P  L  A  G  E
 181 AGAAGCAGATATCGGTGAGCTGTTCCGATGGCCCCACTATGGGGCTCCACTGGCTGGGGA
  60   C  L  S  V  Q  V  V  N  C  S  R  V  F  S  L  R  P  L  G  T
 241 GTGTCTGTCTGTGCAGGTGGTCAACTGCAGCCGTGTATTCAGCCTTAGGCCTCTAGGGAC
  80   L  V  I  S  L  Q  Q  L  Q  N  A  G  H  L  V  L  R  E  A  L
 301 CCTGGTGATCTCCCTGCAGCAGCTACAGAATGCTGGGCATTTGGTGCTACGGGAAGCCCT
 100   V  D  E  N  L  Q  V  S  P  I  Q  V  E  L  D  L  K  Y  Q  P
 361 AGTGGATGAGAATCTTCAAGTGTCCCCGATCCAGGTGGAGCTTGACCTGAAGTACCAGCC
 120   P  E  G  A  T  G  A  W  S  E  E  D  F  G  A  P  I  Q  D  S
 421 CCCAGAGGGCGCTACTGGAGCCTGGTCAGAGGAGGACTTTGGGGCACCCATCCAGGACAG
 140   F  E  L  I  I  P  N  V  G  F  Q  E  L  E  P  G  E  A  Q  L
 481 CTTCGAGTTAATCATCCCCAATGTGGGCTTCCAGGAACTGGAGCCTGGGGAGGCCCAGCT
 160   E  R  R  A  V  A  L  G  R  R  L  A  R  S  L  G  Q  Q  D  D
 541 GGAGCGGCGGGCAGTGGCTCTAGGCCGCAGGCTAGCTCGAAGTCTAGGCCAGCAGGACGA
 180   E  E  N  E  L  E  L  E  Q  D  L  D  D  E  P  D  V  E
 601 TGAAGAGAATGAGCTGGAGCTTGAGCTGGAGCAGGACCTGGATGATGAGCCTGACGTGGA
 200   L  S  G  V  M  F  S  P  L  K  S  R  A  R  A  L  A  H  G  D
 661 ACTTTCTGGTGTTATGTTCAGCCCCCTCAAGAGCCGCGCCAGGGCCCTGGCCCATGGGGA
 220   P  F  Q  V  S  R  A  Q  D  F  Q  V  G  V  T  V  L  E  A  Q
 721 TCCCTTCCAGGTGTCCAGAGCTCAAGACTTCCAGGTGGGAGTCACTGTGCTGGAAGCCCA
 240   K  L  V  G  V  N  I  N  P  Y  V  A  V  Q  V  G  G  Q  R  R
 781 GAAACTGGTGGGAGTCAACATTAACCCCTATGTGGCCGTGCAAGTGGGGGGGCAGCGCCG
 260   V  T  A  T  Q  R  G  T  S  C  P  F  Y  N  E  Y  F  L  F  E
 841 TGTGACCGCCACACAGCGTGGGACCAGTTGCCCCTTCTACAATGAGTACTTCTTGTTCGA
 280   F  H  D  T  R  L  R  L  Q  D  L  L  L  E  I  T  V  S  G  V
 901 ATTTCATGACACGCGGCTTCGTCTCCAAGACTTGCTGCTGGAGATCACGGTGAGTGGGGT
 300   G  V  T  S  V  L  Q  R  R  G  D  E  K  A  A  G  L  T  P  P
 961 AGGGGTGACCAGTGTCCTTCAGAGAAGGGGGGATGAGAAAGCTGCAGGACTAACACCACC
 320   S  P  K  A  F  H  S  Q  T  L  P  F  M  A  T  R  I  G  T  F
1021 TTCCCCCAAGGCTTTCCATTCGCAGACCCTCCCCTTTATGGCCACCCGGATAGGCACCTT
 340   R  M  D  L  G  I  I  L  D  Q  P  D  G  Q  F  Y  Q  R  W  V
1081 CAGGATGGACCTGGGCATCATCTTGGACCAGCCAGATGGCCAGTTCTACCAAAGATGGGT
 360   P  L  H  D  P  R  D  T  R  A  G  T  K  G  F  I  K  V  T  L
1141 TCCGCTGCATGATCCCCGAGACACCCGCGCCGGGACCAAGGGTTTCATTAAGGTCACCTT
 380   S  V  R  A  R  G  D  L  P  P  P  M  L  P  P  A  P  G  H  C
1201 GTCCGTGAGGGCGCGCGGGGACCTGCCCCCTCCAATGCTACCCCCGGCCCCAGGGCACTG
 400   S  D  I  E  K  N  L  L  L  P  R  G  V  P  A  E  R  P  W  A
1261 TTCGGACATCGAGAAGAACCTGCTCCTGCCGCGCGGGGTGCCCGCCGAGAGGCCATGGGC
```

Figure 2Q-3

```
 420  R  L  R  V  R  L  Y  R  A  E  G  L  P  A  L  R  L  G  L  L
1321  GCGGCTCCGCGTGCGCCTGTACCGCGCCGAGGGGCTTCCCGCGCTGCGCCTGGGGCTGCT
 440  G  S  L  V  R  A  L  H  D  Q  R  V  L  V  E  P  Y  V  R  V
1381  GGGCAGCCTGGTCCGCGCCCTGCACGACCAGCGCGTCCTGGTGGAGCCCTATGTGCGGGT
 460  S  F  L  G  Q  E  G  E  T  S  V  S  A  E  A  A  A  P  E  W
1441  GTCTTTCCTGGGGCAGGAGGGCGAGACGTCGGTGAGCGCCGAGGCGGCGGCGCCCGAATG
 480  N  E  Q  L  S  F  V  E  L  F  P  P  L  T  R  S  L  R  L  Q
1501  GAACGAGCAGCTGAGCTTCGTGGAGCTCTTCCCGCCGCTGACGCGCAGCCTCCGCCTGCA
 500  L  R  D  D  A  P  L  V  D  A  A  L  A  T  H  V  P  D  L  R
1561  GCTGCGGGACGACGCGCCCCTGGTCGACGCGGCACTCGCTACGCACGTGCCGGACCTGAG
 520  R  I  S  H  P  G  R  A  A  G  F  N  P  T  F  G  P  A  W  V
1621  GCGGATCTCCCATCCGGGCCGCGCGGCGGGGTTTAACCCTACCTTCGGCCCGGCCTGGGT
 540  P  L  Y  G  S  P  P  G  A  G  L  R  D  S  L  Q  G  L  N  E
1681  GCCCCTCTATGGCTCGCCCCCCGGCGCGGGGCTCCGGGATAGTCTTCAAGGTCTCAACGA
 560  G  V  G  Q  G  I  W  F  R  G  R  L  L  A  V  S  M  Q  V
1741  AGGCGTTGGCCAAGGCATTTGGTTCCGCGGCCGCCTTCTGCTGGCTGTGTCCATGCAGGT
 580  L  E  G  R  A  E  P  E  P  P  Q  A  Q  Q  G  S  T  L  S  R
1801  GTTGGAAGGGAGAGCTGAACCTGAGCCTCCCCAGGCCCAGCAGGGGTCCACGTTGTCCCG
 600  L  T  R  K  K  K  K  A  R  R  D  Q  T  P  K  A  V  P  Q
1861  GCTCACCCGAAAGAAGAAAAAGAAAGCCAGAAGGGATCAGACCCCAAAGGCGGTTCCGCA
 620  H  L  D  A  S  P  G  A  E  G  P  E  I  P  R  A  M  E  V  E
1921  GCACTTGGACGCCAGCCCCGGTGCCGAGGGGCCTGAGATCCCCCGTGCCATGGAGGTGGA
 640  V  E  E  L  L  P  L  P  E  N  V  L  A  P  C  E  D  F  L  L
1981  GGTGGAGGAGCTGCTGCCGCTGCCAGAGAATGTCCTGGCGCCCTGTGAAGATTTCCTGCT
 660  F  G  V  L  F  E  A  T  M  I  D  P  T  V  A  S  Q  P  I  S
2041  TTTCGGTGTGCTCTTCGAGGCCACCATGATCGACCCCACCGTGGCCTCCCAGCCCATCAG
 680  F  E  I  S  I  G  R  A  G  R  L  E  E  Q  L  G  R  G  S  R
2101  CTTCGAGATCTCCATTGGTCGCGCAGGCCGTCTGGAGGAGCAATTGGGCCGAGGGTCCAG
 700  A  G  E  G  T  E  G  A  A  V  E  A  Q  P  L  L  G  A  R  P
2161  GGCTGGGGAGGGAACTGAGGGTGCAGCCGTGGAGGCTCAGCCTCTGCTGGGAGCCAGGCC
 720  E  E  E  K  E  E  E  E  L  G  T  H  A  Q  R  P  E  P  M  D
2221  AGAGGAGGAGAAAGAGGAGGAAGAACTGGGGACCCATGCTCAGCGGCCTGAGCCCATGGA
 740  G  S  G  P  Y  F  C  L  P  L  C  H  C  K  P  C  M  H  V  W
2281  CGGCAGTGGGCCATACTTCTGCTTGCCCCTCTGTCACTGCAAGCCATGCATGCATGTGTG
 760  S  C  W  E  D  H  T  W  R  L  Q  S  S  N  C  V  R  K  V  A
2341  GAGTTGCTGGGAGGACCACACCTGGCGCCTGCAGAGCAGCAACTGCGTGCGCAAAGTGGC
 780  E  R  L  D  Q  G  L  Q  E  V  E  R  L  Q  R  K  P  G  P  G
2401  CGAGAGGCTGGACCAGGGGCTGCAGGAGGTTGAGAGACTGCAGCGCAAGCCGGGGCCTGG
 800  A  C  A  Q  L  K  Q  A  L  E  V  L  V  A  G  S  R  Q  F  C
```

Figure 2Q-4

```
2461 CGCCTGTGCACAGCTCAAGCAGGCACTGGAAGTACTGGTGGCTGGGAGCAGACAGTTTTG
 820   H  G  A  E  R  R  T  M  T  R  P  N  A  L  D  R  C  R  G  K
2521 CCACGGTGCCGAGCGCAGGACGATGACCCGGCCCAATGCCCTGGATCGATGCCGAGGGAA
 840   L  L  V  H  S  L  N  L  L  A  K  Q  G  L  R  L  L  R  G  L
2581 ACTCCTGGTGCACAGCCTGAACCTTTTGGCTAAGCAAGGACTGCGACTTCTACGCGGCCT
 860   R  R  R  N  V  Q  K  K  V  A  L  A  K  K  L  L  A  K  L  R
2641 GAGACGGCGCAATGTGCAAAAGAAGGTGGCACTGGCCAAGAAGCTCCTGGCAAAACTGCG
 880   F  L  A  E  E  P  Q  P  P  L  P  D  V  L  V  W  M  L  S  G
2701 CTTTCTGGCTGAGGAGCCCCAGCCACCCCTCCCCGATGTGCTGGTCTGGATGCTCAGCGG
 900   Q  R  R  V  A  W  A  R  I  P  A  Q  D  V  L  F  S  V  V  E
2761 GCAGCGCCGTGTGGCCTGGGCCCGGATCCCTGCCCAGGATGTGCTGTTCTCTGTGGTTGA
 920   E  E  R  G  R  D  C  G  K  I  Q  S  L  M  L  T  A  P  G  A
2821 GGAGGAACGGGGCCGAGACTGTGGGAAGATCCAGAGTCTAATGCTCACGGCACCCGGGGC
 940   A  P  G  E  V  C  A  K  L  E  F  L  R  L  G  L  G  K  Q
2881 AGCCCCTGGTGAGGTCTGTGCCAAGCTGGAGCTCTTCCTGCGGCTGGGCCTGGGCAAGCA
 960   A  K  A  C  T  S  E  L  P  P  D  L  L  P  E  P  S  A  G  L
2941 AGCCAAGGCCTGCACCTCTGAGCTGCCCCCGGATTTGCTGCCCGAGCCCTCAGCCGGGCT
 980   P  S  S  L  H  R  D  D  F  S  Y  F  Q  L  R  A  H  L  Y  Q
3001 GCCCTCCAGCCTACACCGGGACGACTTTAGCTACTTCCAACTCCGGGCTCACTTGTACCA
1000   A  R  G  V  L  A  A  D  D  S  G  L  S  D  P  F  A  R  V  L
3061 GGCCCGGGGTGTGTTGGCTGCAGATGACAGTGGCCTCTCGGACCCCTTTGCTCGAGTCCT
1020   I  S  T  Q  C  Q  T  T  R  V  L  E  Q  T  L  S  P  L  W  D
3121 CATCTCTACCCAGTGTCAGACCACACGGGTCCTGGAGCAGACGCTGAGCCCTCTGTGGGA
1040   E  L  L  V  F  E  Q  L  I  V  D  G  R  R  E  H  L  Q  E  E
3181 TGAACTCCTGGTATTTGAGCAGTTGATCGTGGATGGGAGGAGGGAGCACCTGCAGGAGGA
1060   P  P  L  V  I  I  N  V  F  D  H  N  K  F  G  P  P  V  F  L
3241 GCCTCCATTAGTGATCATCAATGTATTTGACCACAATAAGTTTGGCCCCCCCGTGTTCCT
1080   G  R  A  L  A  A  P  R  V  K  L  M  E  D  P  Y  Q  R  P  E
3301 GGGCAGGGCACTGGCCGCCCCAAGGGTAAAGCTGATGGAGGACCCATACCAACGCCCAGA
1100   L  Q  F  F  P  L  R  K  G  P  W  A  A  G  E  L  I  A  A  F
3361 GTTGCAGTTCTTCCCCCTGAGGAAGGGACCCTGGGCAGCCGGAGAGCTCATTGCCGCCTT
1120   Q  L  I  E  L  D  Y  S  G  R  L  E  P  S  V  P  S  E  V  E
3421 TCAACTCATTGAACTAGACTACAGTGGCCGACTTGAGCCCTCAGTGCCCAGTGAGGTGGA
1140   P  Q  D  L  A  P  L  V  E  P  H  S  G  R  L  S  L  P  P  N
3481 GCCCCAGGATCTGGCACCCCTGGTTGAGCCCCACTCTGGACGCCTGTCCCTTCCACCCAA
1160   V  C  P  V  L  R  E  F  R  V  E  V  L  F  W  G  L  R  G  L
3541 CGTGTGCCCAGTGCTCAGGGAGTTCCGTGTTGAGGTGCTGTTCTGGGGTCTTAGGGGACT
1180   G  R  V  H  L  L  F  V  E  Q  P  Q  V  V  L  E  V  A  G  Q
3601 TGGTCGTGTGCATCTGCTCGAGGTGGAGCAGCCCCAGGTTGTACTGGAGGTGGCTGGGCA
```

Figure 2Q-5

```
1200     G  V  E  S  E  V  L  A  S  Y  R  E  S  P  N  F  T  E  L  V
3661   AGGTGTGGAGTCTGAGGTCCTGGCCAGCTACCGTGAGAGCCCCAATTTCACTGAGCTTGT
1220     R  H  L  T  V  D  L  P  E  Q  P  Y  L  Q  P  P  L  S  I  L
3721   CAGGCATCTGACAGTGGACTTGCCGGAGCAGCCTTACTTGCAGCCTCCACTCAGCATCTT
1240     V  I  E  R  R  A  F  G  H  T  V  L  V  G  S  H  I  V  P  H
3781   GGTGATTGAGCGCCGGGCCTTTGGCCACACAGTCCTTGTGGGTTCCCACATTGTCCCCCA
1260     M  L  R  F  T  F  R  G  H  E  D  P  P  E  E  E  G  E  M  E
3841   CATGCTGCGATTCACATTTCGGGGTCATGAGGATCCTCCTGAGGAGGAAGGAGAGATGGA
1280     E  T  G  D  M  M  P  K  G  P  Q  G  Q  K  S  L  D  P  F  L
3901   GGAGACAGGGGATATGATGCCCAAGGGACCTCAAGGACAGAAGTCCCTGGATCCCTTCTT
1300     A  E  A  G  I  S  R  Q  L  L  K  P  P  L  K  K  L  P  L  G
3961   GGCTGAAGCGGGTATATCCAGACAGCTCCTGAAGCCTCCTCTGAAGAAGCTCCCACTAGG
1320     G  L  L  N  Q  G  P  G  L  E  E  D  I  P  D  P  E  E  L  D
4021   AGGCCTCCTAAATCAAGGCCCTGGGCTGGAGGAAGACATCCCAGATCCAGAGGAGCTCGA
1340     W  G  S  K  Y  Y  A  S  L  Q  E  L  Q  G  Q  H  N  F  D  E
4081   CTGGGGGTCCAAGTACTATGCGTCGCTGCAGGAGCTCCAGGGGCAGCACAACTTTGATGA
1360     D  E  M  D  D  P  G  D  S  D  G  V  N  L  I  S  M  V  G  E
4141   AGATGAAATGGATGATCCTGGAGATTCAGATGGGGTCAACCTCATTTCTATGGTTGGGGA
1380     I  Q  D  Q  G  E  A  E  V  K  G  T  V  S  P  K  K  A  V  A
4201   GATCCAAGACCAGGGTGAGGCTGAAGTCAAAGGCACTGTGTCCCCAAAAAAAGCAGTTGC
1400     T  L  K  I  Y  N  R  S  L  E  E  E  F  N  H  F  E  D  W  L
4261   CACCCTGAAGATCTACAACAGGTCCCTGGAGGAAGAATTTAACCACTTTGAAGACTGGCT
1420     N  V  F  P  L  Y  R  G  Q  G  G  Q  D  G  G  G  E  E  E  G
4321   GAATGTGTTTCCTCTGTACCGAGGGCAAGGGGGCCAGGATGGAGGTGGAGAAGAGGAAGG
1440     S  G  H  L  V  G  K  F  K  G  S  F  L  I  Y  P  E  S  E  A
4381   ATCTGGACACCTTGTGGGCAAGTTCAAGGGCTCCTTCCTCATTTACCCTGAATCAGAGGC
1460     V  L  F  S  E  P  Q  I  S  R  G  I  P  Q  N  R  P  I  K  L
4441   AGTGTTGTTCTCTGAGCCCCAGATCTCCCGGGGGATCCCACAGAACCGGCCCATCAAGCT
1480     L  V  R  V  Y  V  V  K  A  T  N  L  A  P  A  D  P  N  G  K
4501   CCTGGTCAGAGTGTATGTTGTAAAGGCTACCAACCTGGCTCCTGCAGACCCCAATGGCAA
1500     A  D  P  Y  V  V  V  S  A  G  R  E  R  Q  D  T  K  E  R  Y
4561   AGCAGACCCTTACGTGGTGGTGAGCGCTGGCCGGGAGCGGCAGGACACCAAGGAACGCTA
1520     I  P  K  Q  L  N  P  I  F  G  E  I  L  E  L  S  I  S  L  P
4621   CATCCCCAAGCAGCTCAACCCCATCTTTGGAGAGATCCTGGAGCTAAGCATCTCTCTCCC
1540     A  E  T  E  L  T  V  A  V  F  D  H  D  L  V  G  S  D  D  L
4681   AGCTGAGACGGAGCTGACGGTCGCCGTATTTGATCATGACCTCGTGGGTTCTGACGACCT
1560     I  G  E  T  H  I  D  L  E  N  R  F  Y  S  H  H  R  A  N  C
4741   CATCGGGGAGACCCACATTGATCTGGAAAACCGATTCTATAGCCACCACAGAGCAAACTG
1580     G  L  A  S  Q  Y  E  V  D  G  Y  N  A  W  R  D  A  F  W  P
```

Figure 2Q-6

```
4801 TGGGCTGGCCTCCCAGTATGAAGTAGATGGTTACAATGCCTGGCGTGATGCATTCTGGCC
1600  S  Q  I  L  A  G  L  C  Q  R  C  G  L  P  A  P  E  Y  R  A
4861 TTCGCAGATCCTGGCGGGGCTGTGCCAACGCTGTGGCCTCCCTGCCCCTGAATACCGAGC
1620  G  A  V  K  V  G  S  K  V  F  L  T  P  P  E  T  L  P  P  V
4921 CGGTGCTGTCAAGGTGGGCAGCAAAGTCTTCCTGACACCACCGGAGACCCTGCCCCCAGT
1640  A  S  G  D  P  E  E  A  Q  A  L  L  V  L  R  R  W  Q  E  M
4981 GGCGAGCGGGGACCCTGAAGAGGCCCAGGCATTGCTTGTGCTGCGGCGCTGGCAGGAAAT
1660  P  G  F  G  I  Q  L  V  P  E  H  V  E  T  R  P  L  Y  H  P
5041 GCCGGGTTTTGGGATCCAGCTGGTACCCGAGCATGTAGAAACCAGGCCTCTCTACCATCC
1680  H  S  P  G  L  L  Q  G  S  L  H  M  W  I  D  I  F  P  Q  D
5101 CCACAGCCCAGGGCTGCTACAGGGATCTCTTCACATGTGGATTGACATCTTTCCTCAAGA
1700  V  P  A  P  P  P  V  D  I  K  P  R  Q  P  I  S  Y  E  L  R
5161 TGTGCCTGCTCCACCCCCAGTTGACATCAAGCCTCGGCAGCCAATCAGCTATGAGCTCAG
1720  V  V  I  W  N  T  E  D  V  V  L  D  D  E  N  P  L  T  G  E
5221 AGTTGTCATCTGGAACACGGAGGATGTGGTTCTGGATGACGAGAATCCACTCACCGGAGA
1740  M  S  S  D  I  Y  V  K  S  W  V  K  G  L  E  H  D  K  Q  E
5281 GATGTCGAGTGACATCTATGTGAAGAGCTGGGTGAAGGGGTTGGAGCATGACAAGCAGGA
1760  T  D  V  H  F  N  S  L  T  G  E  G  N  F  N  W  R  F  V  F
5341 GACAGACGTTCACTTCAACTCCCTGACTGGGGAGGGGAACTTCAATTGGCGCTTTGTGTT
1780  R  F  D  Y  L  P  T  E  R  E  V  S  V  W  R  R  S  G  P  F
5401 CCGCTTTGACTACCTGCCCACGGAGCGGGAGGTGAGCGTCTGGCGCAGGTCTGGACCCTT
1800  A  L  E  E  A  E  F  R  Q  P  A  V  L  V  L  Q  V  W  D  Y
5461 TGCCCTGGAGGAGGCGGAGTTCCGGCAGCCTGCAGTGCTGGTCCTGCAGGTCTGGGACTA
1820  D  R  I  S  A  N  D  F  L  G  S  L  E  L  Q  L  P  D  M  V
5521 TGACCGCATCTCTGCCAATGACTTCCTTGGATCCCTGGAGTTGCAGCTACCAGACATGGT
1840  R  G  A  R  G  P  E  L  C  S  V  Q  L  A  R  N  G  A  G  P
5581 GCGTGGGGCCCGGGGCCCCGAGCTCTGCTCTGTGCAGCTGGCCCGCAATGGGGCCGGGCC
1860  R  C  N  L  F  R  C  R  R  L  R  G  W  W  P  V  V  K  L  K
5641 GAGGTGCAATCTGTTTCGCTGCCGCCGCCTGAGGGGCTGGTGGCCGGTAGTGAAGCTGAA
1880  E  A  E  D  V  E  R  E  A  Q  E  A  Q  A  G  K  K  K  R  K
5701 GGAGGCAGAGGACGTGGAGCGGGAGGCGCAGGAGGCTCAGGCTGGCAAGAAGAAGCGAAA
1900  Q  R  R  K  G  R  P  E  D  L  E  F  T  D  M  G  G  N  V
5761 GCAGAGGAGGAAGGGCCGGCCAGAAGACCTGGAGTTCACAGACATGGGTGGCAATGT
1920  Y  I  L  T  G  K  V  E  A  E  F  E  L  L  T  V  E  E  A  E
5821 GTACATCCTCACGGGCAAGGTGGAGGCAGAGTTTGAGCTGCTGACTGTGGAGGAGGCCGA
1940  K  R  P  V  G  K  G  R  K  Q  P  E  P  L  E  K  P  S  R  P
5881 GAAACGGCCAGTGGGGAAGGGCGGAAGCAGCCAGAGCCTCTGGAGAAACCCAGCCGCCC
1960  K  T  S  F  N  W  F  V  N  P  L  K  T  F  V  F  F  I  W  R
5941 CAAAACTTCCTTCAACTGGTTTGTGAACCCGCTGAAGACCTTTGTCTTCTTCATCTGGCG
```

Figure 2Q-7

```
1980  R  Y  W  R  T  L  V  L  L  L  V  L  L  T  V  F  L  L  L
6001  CCGGTACTGGCGCACCCTGGTGCTGCTGCTACTGGTGCTGCTCACCGTCTTCCTCCTCCT
2000  V  F  Y  T  I  P  G  Q  I  S  Q  V  I  F  R  P  L  H  K  *
6061  GGTCTTCTACACCATCCCTGGCCAGATCAGCCAGGTCATCTTCCGTCCCCTCCACAAGTG
6121  Actctcgctgaccttggacactcacccagggtgccaacccttcaatgcctgctcctggaa
6181  gtctttcttacccatgtgagctacccagagtctagtgcttcctctgaataaacctatca
6241  cagcc
```

Figure 2R. 158P3D2 v.9 through v.13, SNP variants of 158P3D2 v.1.

| Variant | Nucleic acid position | Nucleic Acid Variation | Amino Acid Position | Amino Acid Variation |
|---|---|---|---|---|
| 158P3D2 v.9 | 150 | C/G | in the untranslated region | None |
| 158P3D2 v.10 | 1022 | C/A | 58 | S=>R |
| 158P3D2 v.11 | 1148 | G/A | 100 | Silent variant |
| 158P3D2 v.12 | 1691 | G/T | 281 | K=>N |
| 158P3D2 v.13 | 1692 | A/G | 282 | T=>A |

Figure 3

Figure 3A. Amino acid sequence of 158P2D3 v.1 clone 158P3D2-BCP1 (SEQ ID. NO:36).
The 158P3D2 v.1 protein has 328 amino acids.

```
  1 MWIDIFPQDV PAPPPVDIKP RQPISYELRV VIWNTEDVVL DDENPLTGEM
 51 SSDIYVKSWV KGLEHDKQET DVHFNSLTGE GNFNWRFVFR FDYLPTEREV
101 SVWRRSGPFA LEEAEFRQPA VLVLQVWDYD RISANDFLGS LELQLPDMVR
151 GARGPELCSV QLARNGAGPR CNLFRCRRLR GWWPVVKLKE AEDVEREAQE
201 AQAGKKKRKQ RRRKGRPEDL EFTDMGGNVY ILTGKVEAEF ELLTVEEAEK
251 RPVGKGRKQP EPLEKPSRPK TSFNWFVNPL KTFVFFIWRR YWRTLVLLLL
301 VLLTVFLLLV FYTIPGQISQ VIFRPLHK
```

Figure 3B. Amino acid sequence of 158P2D3 v.2A (SEQ ID NO:37). The 158P3D2 v.2A protein has 236 amino acids.

```
  1 MDDPGDSDGV NLISMVGEIQ DQGEAEVKGT VSPKKAVATL KIYNRSLEEE
 51 FNHFEDWLNV FPLYRGQGGQ DGGGEEEGSG HLVGKFKGSF LIYPESEAVL
101 FSEPQISRGI PQNRPIKLLV RVYVVKATNL APADPNGKAD PYVVVSAGRE
151 RQDTKERYIP KQLNPIFGEI LELSISLPAE TELTVAVFEH DLVGSDDLIG
201 ETHIDLENRF YSHHRANCGL ASQYEVWVQQ GPQEPF
```

Figure 3C. Amino acid sequence of 158P2D3 v.2B (SEQ ID NO:38). The 158P3D2 v.2B protein has 181 amino acids.

```
  1 MVRGARGPEL CSVQLARNGA GPRCNLFRCR RLRGWWPVVK LKEAEDVERE
 51 AQEAQAGKKK RKQRRRKGRP EDLEFTDMGG NVYILTGKVE AEFELLTVEE
101 AEKRPVGKGR KQPEPLEKPS RPKTSFNWFV NPLKTFVFFI WRRYWRTLVL
151 LLLVLLTVFL LLVFYTIPGQ ISQVIFRPLH K
```

Figure 3D. Amino acid sequence of 158P2D3 v.3 (SEQ ID NO:39). The 158P3D2 v.3 protein has 328 amino acids.

```
  1 MWIDIFPQDV PAPPPVDIKP RQPISYELRV VIWNTEDVVL DDENPLTGEM
 51 SSDIYVKSWV KGLEHDKQET DVHFNSLTGE GNFNWRFVFR FDYLPTEREV
101 SVRRRSGPFA LEEAEFRQPA VLVLQVWDYD RISANDFLGS LELQLPDMVR
151 GARGPELCSV QLARNGAGPR CNLFRCRRLR GWWPVVKLKE AEDVEREAQE
201 AQAGKKKRKQ RRRKGRPEDL EFTDMGGNVY ILTGKVEAEF ELLTVEEAEK
251 RPVGKGRKQP EPLEKPSRPK TSFNWFVNPL KTFVFFIWRR YWRTLVLLLL
301 VLLTVFLLLV FYTIPGQISQ VIFRPLHK
```

Figure 3E. Amino acid sequence of 158P2D3 v.4 (SEQ ID NO:40). The 158P3D2 v.4 protein has 328 amino acids.

```
  1 MWIDIFPQDV PAPPPVDIKP RQPISYELRV VIWNTEDVVL DDENPLTGEM
 51 SSDIYVKSWV KGLEHDKQET DVHFNSLTGE GNFNWRFVFR FDYLPTEREV
101 SIWRRSGPFA LEEAEFRQPA VLVLQVWDYD RISANDFLGS LELQLPDMVR
151 GARGPELCSV QLARNGAGPR CNLFRCRRLR GWWPVVKLKE AEDVEREAQE
201 AQAGKKKRKQ RRRKGRPEDL EFTDMGGNVY ILTGKVEAEF ELLTVEEAEK
251 RPVGKGRKQP EPLEKPSRPK TSFNWFVNPL KTFVFFIWRR YWRTLVLLLL
301 VLLTVFLLLV FYTIPGQISQ VIFRPLHK
```

Figure 3F. Amino acid sequence of 158P2D3 v.5A (SEQ ID NO:41). The 158P3D2 v.5A protein has 178 amino acids.

```
  1 MWIDIFPQDV PAPPPVDIKP RQPISYELRV VIWNTEDLVL DDENPLTGEM
 51 SSDIYVKSWV KGLEHDKQET DVHFNSLTGE GNFNWRFVFR FDYLPTEREV
101 SVWRRSGPFA LEEAEFRQPA VLVLQVWDYT ASLPMTSLDP WSCSYQTWCV
151 GPGAPSSALC SWPAMGPGRG AICFAAAA
```

Figure 3G. Amino acid sequence of 158P2D3 v.5B (SEQ ID NO:42). The 158P3D2 v.5B protein has 181 amino acids.

```
  1 MVRGARGPEL CSVQLARNGA GPRCNLFRCR RLRGWWPVVK LKEAEDVERE
 51 AQEAQAGKKK RKQRRRKGRP EDLEFTDMGG NVYILTGKVE AEFELLTVEE
101 AEKRPVGKGR KQPEPLEKPS RPKTSFNWFV NPLKTFVFFI WRRYWRTLVL
151 LLLVLLTVFL LLVFYTIPGQ ISQVIFRPLH K
```

Figure 3H. Amino acid sequence of 158P2D3 v.10 (SEQ ID NO:43). The 158P3D2 v.10 protein has 328 amino acids.

```
  1 MWIDIFPQDV PAPPPVDIKP RQPISYELRV VIWNTEDVVL DDENPLTGEM
 51 SSDIYVKRWV KGLEHDKQET DVHFNSLTGE GNFNWRFVFR FDYLPTEREV
101 SVWRRSGPFA LEEAEFRQPA VLVLQVWDYD RISANDFLGS LELQLPDMVR
151 GARGPELCSV QLARNGAGPR CNLFRCRRLR GWWPVVKLKE AEDVEREAQE
201 AQAGKKKRKQ RRRKGRPEDL EFTDMGGNVY ILTGKVEAEF ELLTVEEAEK
251 RPVGKGRKQP EPLEKPSRPK TSFNWFVNPL KTFVFFIWRR YWRTLVLLLL
301 VLLTVFLLLV FYTIPGQISQ VIFRPLHK
```

Figure 3I. Amino acid sequence of 158P2D3 v.11 (SEQ ID NO:44). The 158P3D2 v.11 protein has 328 amino acids.

```
  1 MWIDIFPQDV PAPPPVDIKP RQPISYELRV VIWNTEDVVL DDENPLTGEM
 51 SSDIYVKSWV KGLEHDKQET DVHFNSLTGE GNFNWRFVFR FDYLPTEREV
101 SVWRRSGPFA LEEAEFRQPA VLVLQVWDYD RISANDFLGS LELQLPDMVR
151 GARGPELCSV QLARNGAGPR CNLFRCRRLR GWWPVVKLXE AEDVEREAQE
201 AQAGKKKRKQ RRRKGRPEDL EFTDMGGNVY ILTGKVEAEF ELLTVEEAEK
251 RPVGKGRKQP EPLEKPSRPK TSFNWFVNPL KTFVFFIWRR YWRTLVLLLL
301 VLLTVFLLLV FYTIPGQISQ VIFRPLHK
```

Figure 3J. Amino acid sequence of 158P2D3 v.12 (SEQ ID NO:45). The 158P3D2 v.12 protein has 328 amino acids.

```
  1 MWIDIFPQDV PAPPPVDIKP RQPISYELRV VIWNTEDVVL DDENPLTGEM
 51 SSDIYVKSWV KGLEHDKQET DVHFNSLTGE GNFNWRFVFR FDYLPTEREV
101 SVWRRSGPFA LEEAEFRQPA VLVLQVWDYD RISANDFLGS LELQLPDMVR
151 GARGPELCSV QLARNGAGPR CNLFRCRRLR GWWPVVKLXE AEDVEREAQE
201 AQAGKKKRKQ RRRKGRPEDL EFTDMGGNVY ILTGKVEAEF ELLTVEEAEK
251 RPVGKGRKQP EPLEKPSRPK TSFNWFVNPL NTFVFFIWRR YWRTLVLLLL
301 VLLTVFLLLV FYTIPGQISQ VIFRPLHK
```

Figure 3K. Amino acid sequence of 158P2D3 v.13 (SEQ ID NO:46). The 158P3D2 v.13 protein has 328 amino acids.

```
  1 MWIDIFPQDV PAPPPVDIKP RQPISYELRV VIWNTEDVVL DDENPLTGEM
 51 SSDIYVKSWV KGLEHDKQET DVHFNSLTGE GNFNWRFVFR FDYLPTEREV
101 SVWRRSGPFA LEEAEFRQPA VLVLQVWDYD RISANDFLGS LELQLPDMVR
151 GARGPELCSV QLARNGAGPR CNLFRCRRLR GWWPVVKLXE AEDVEREAQE
201 AQAGKKKRKQ RRRKGRPEDL EFTDMGGNVY ILTGKVEAEF ELLTVEEAEK
251 RPVGKGRKQP EPLEKPSRPK TSFNWFVNPL KAFVFFIWRR YWRTLVLLLL
301 VLLTVFLLLV FYTIPGQISQ VIFRPLHK
```

Figure 3L. Amino acid sequence of 158P2D3 v.14 (SEQ ID NO:47). The 158P3D2 v.14 protein has 1393 amino acids.

```
  1 MALTVSVQRL TGLTGTHDRQ VKLTFRGFTQ KTRKIHCGPE ADIGELFRWP HYGAPLAGEC
 61 LSVQVVNCSR VFSLRPLGTL VISLQQLQNA GHLVLREALV DENLQVSPIQ VELDLKYQPP
121 EGATGAWSEE DFGAPIQDSF ELIIPNVGFQ ELEPGEAQLE RRAVALGRRL ARSLCQQDDE
181 ENELELELEQ DLDDEPDVEL SGVMFSPLKS RARALAHGDP FQVSRAQDFQ VGVTVLEAQK
241 LVGVNINPYV AVQVGGQRRV TATQRGTSCP FYNEYFLFEF HDTRLRLQDL LLEITVSGVG
301 VTSVLQRRGD EKAAGLTPPS PKAFHSQTLP FMATRIGTFR MDLGITLDQP DGQFYQRWVP
```

Figure 3L-2

```
 361 LHDPRDTRAG TKGFIKVTLS VRARGDLPPP MLPPAPGHCS DIEKNLLLPR GVPAERPWAR
 421 LRVRLYRAEG LPALRLGLLG SLVRALHDQR VLVEPYVRVS FLGQEGETSV SAEAAAPEWN
 481 EQLSFVELFP PLTRSLRLQL RDDAPLVDAA LATHVPDLRR ISHPGRAAGF NPTFGPAWVP
 541 LYGSPPGAGL RDSLQGLNEG VGQGIWFRGR LLLAVSMQVL EGRAEPEPPQ AQQGSTLSRL
 601 TRKKKKKARR DQTPKAVPQH LDASPGAEGP EIPRAMEVEV EELLPLPENV LAPCEDFLLF
 661 GVLFEATMID PTVASQPISF EISIGRAGRL EEQLGRGSRA GEGTEGAAVE AQPLLGARPE
 721 EEKEEEELGT HAQRPEPMDG SGPYFCLPLC HCKPCMHVWS CWEDHTWRLQ SSNCVRKVAE
 781 RLDQGLQEVE RLQRKPGPGA CAQLKQALEV LVAGSRQFCH GAERRTMTRP NALDRCRGKL
 841 LVHSLNLLAK QGLRLLRGLR RRNVQKKVAL AKKLLAKLRF LAEEPQPPLP DVLVWMLSGQ
 901 RRVAWARIPA QDVLFSVVEE ERGRDCGKIQ SLMLTAPGAA PGEVCAKLEL FLRLGLGKQA
 961 KACTSELPPD LLPFPSAGLP SSLHRDDFSY FQLRAHLYQA RGVLAADDSG LSDPFARVLI
1021 STQCQTTRVL EQTLSPLWDE LLVFEQLIVD GRREHLQEEP PLVIINVFDH NKFGPPVFLG
1081 RALAAPRVKL MEDPYQRPEL QFFPLRKGPW AAGELIAAFQ LIELDYSGRL EPSVPSEVEP
1141 QDLAPLVEPH SGRLSLPPNV CPVLREFRVE VLFWGLRGLG RVHLLEVEQP QVVLEVAGQG
1201 VESEVLASYR ESPNFTELVR HLTVDLPEQP YLQPPLSILV IERRAFGHTV LVGSHIVPHM
1261 LRFTFRGHED PPEEEGEMEE TGDMMPKGPQ GQKSLDPFLA EAGISRQLLK PPLKKLPLGG
1321 LLNQGPGLEE DIPDPEELDW GSKYYASLQE LQGQHNFDED EMDDPGDSDG VNLISMVGEI
1381 QDQDLQQVPE GRI
```

Figure 3M. Amino acid sequence of 158P2D3 v.15 (SEQ ID NO:48). The 158P3D2 v.15 protein has 1145 amino acids.

```
   1 MALTVSVQRL TGLTGTHDRQ VKLTFRGFTQ KTRKIHCGPE ADIGELFRWP HYGAPLAGEC
  61 LSVQVVNCSR VFSLRPLGTL VISLQQLQNA GHLVLREALV DENLQVSPIQ VELDLKYQPP
 121 EGATGAWSEE DFGAPIQDSF ELIIPNVGFQ ELEPGEAQLE RRAVALGRRL ARSLGQQDDE
 181 ENELELELEQ DLDDEPDVEL SGVMFSPLKS RARALAHGDP FQVSRAQDFQ VGVTVLEAQK
 241 LVGVNINPYV AVQVGGQRRV TATQRGTSCP FYNEYFLFEF HDTRLRLQDL LLEITVSGVG
 301 VTSVLQRRGD EKAAGLTPPS PKAFHSQTLP FMATRIGTFR MDLGIILDQP DGQFYQRWVP
 361 LHDPRDTRAG TKGFIKVTLS VRARGDLPPP MLPPAPGHCS DIEKNLLLPR GVPAERPWAR
 421 LRVRLYRAEG LPALRLGLLG SLVRALHDQR VLVEPYVRVS FLGQEGETSV SAEAAAPEWN
 481 EQLSFVELFP PLTRSLRLQL RDDAPLVDAA LATHVPDLRR ISHPGRAAGF NPTFGPAWVP
 541 LYGSPPGAGL RDSLQGLNEG VGQGIWFRGR LLLAVSMQVL EGRAEPEPPQ AQQGSTLSRL
 601 TRKKKKKARR DQTPKAVPQH LDASPGAEGP EIPRAMEVEV EELLPLPENV LAPCEDFLLF
 661 GVLFEATMID PTVASQPISF EISIGRAGRL EEQLGRGSRA GEGTEGAAVE AQPLLGARPE
 721 EEKEEEELGT HAQRPEPMDG SGPYFCLPLC HCKPCMHVWS CWEDHTWRLQ SSNCVRKVAE
 781 RLDQGLQEVE RLQRKPGPGA CAQLKQALEV LVAGSRQFCH GAERRTMTRP NALDRCRGKL
 841 LVHSLNLLAK QGLRLLRGLR RRNVQKKVAL AKKLLAKLRF LAEEHNFDED EMDDPGDSDG
 901 VNLISMVGEI QDQGEAEVKG TVSPKKAVAT LKIYNRSLKE EFNHFEDWLN VFPLYRGQGG
```

Figure 3M-2

```
 961 QDGGGEEEGS GHLVGKFKGS FLIYPESEAV LFSEPQISRG IPQNRPIKLL VRVYVVKLRN
1021 LCKIQGHEDF CLFSAATNLA PADPNGKADP YVVVSAGRER QDTKERYIPK QLNPIFGEIL
1081 ELSISLPAET ELTVAVFDHD LVGSDDLIGE THIDLENRFY SHHRANCGLA SQYEVWVQQG
1141 PQEPF
```

Figure 3N. Amino acid sequence of 158P2D3 v.16 (SEQ ID NO:49). The 158P3D2 v.16 protein has 1990 amino acids.

```
   1 MALTVSVQRL TGLTGTHDRQ VKLTFRGFTQ KTRKIHCGPE ADIGELFRWP HYGAPLAGEC
  61 LSVQVVNCSR VFSLRPLGTL VISLQQLQNA GHLVLREALV DENLQVSPIQ VELDLKYQPP
 121 EGATGAWSEE DFGAPIQDSF ELIIPNVGFQ ELEPGEAQLE RRAVALGRRL ARSLGQQDDE
 181 ENELELELEQ DLDDEPDVEL SGVMFSPLKS RARALAHGDP FQVSRAQDFQ VGVTVLEAQK
 241 LVGVNINPYV AVQVGGQRRV TATQRGTSCP FYNEYFLFEF HDTRLRLQDL LLEITVSGVG
 301 VTSVLQRRGD EKAAGLTPPS PKAFHSQTLP FMATRIGTFR MDLGIILDQP DGQFYQRWVP
 361 LHDPRDTRAG TKGFIKVTLS VRARGDLPPP MLPPAPGHCS DIEKNLLLPR GVPAERPWAR
 421 LRVRLYRAEG LPALRLGLLG SLVRALHDQR VLVEPYVRVS FLGQEGETSV SAEAAAPEWN
 481 EQLSFVELFP PLTRSLRLQL RDDAPLVDAA LATHVPDLRR ISHPGRAAGF NPTFGPAWVP
 541 LYGSPPGAGL RDSLQGLNEG VGQGIWFRGR LLLAVSMQVL EGRAEPEPPQ AQQGSTLSRL
 601 TRKKKKKARR DQTPKAVPQH LDASPGAEGP EIPRAMEVEV EELLPLPENV LAPCEDFLLF
 661 GVLFEATMID PTVASQPTSF ETSIGRAGRL FFQLGRGSRA GEGTFGAAVE AQPLLGARPE
 721 EEKEEEELGT HAQRPEPMDG SGPYFCLPLC HCKPCMHVWS CWEDHTWRLQ SSNCVRKVAE
 781 RLDQGLQEVE RLQRKPGPGA CAQLKQALEV LVAGSRQFCH GAERRTMTRP NALDRCRGKL
 841 LVHSLNLLAK QGLRLLRGLR RRNVQKKVAL AKKLLAKLRF LAEEPQPPLP DVLVWMLSGQ
 901 RRVAWARIPA QDVLFSVVEE ERGRDCGKIQ SLMLTAPGAA PGEVCAKLEL FLRLGLGKQA
 961 KACTSELPPD LLPEPSAGLP SSLHRDDFSY FQLRAHLYQA RGVLAADDSG LSDPFARVLI
1021 STQCQTTRVL EQTLSPLWDE LLVFEQLIVD GRREHLQEEP PLVIINVFDH NKFGPPVFLG
1081 RALAAPRVKL MEDPYQRPEL QFFPLRKGPW AAGELIAAFQ LIELDYSGRL EPSVPSEVEP
1141 QDLAPLVEPH SCRLSLPPNV CPVLREFRVE VLFWGLRGLG RVHLLEVEQP QVVLEVAGQG
1201 VESEVLASYR ESPNFTELVR HLTVVFKDTA PLFHPQDLPE QPYLQPPLSI LVIERRAFGH
1261 TVLVGSHIVP HMLRFTFRGH EDPPEEEGEM EETGDMMPKG PQGQKSLDPF LAEAGISRQL
1321 LKPPLKKLPL GGLLNQGPGL EEDIPDPEEL DWGSKYYASL QELQGQIINFD EDEMDDPGDS
1381 DGVNLISMVG EIQDQGEAEV KGTVSPKKAV ATLKIYNRSL KEEFNHFEDW LNVFPLYRGQ
1441 GGQDGGGEEE GSGHLVGKFK GSFLIYPESE AVLFSEPQIS RGIPQNRPIK LLVRVYVVKA
1501 TNLAPADPNG KADPYVVVSA GRERQDTKER YIPKQLNPIF GEILELSISL PAETELTVAV
1561 FDHDLVGSDD LIGETHIDLE NRFYSHHRAN CGLASQYEVD GYNAWRDAFW PSQILAGLCQ
1621 RCGLPAPEYR AGAVKVGSKV FLTPPETLPP VASGDPEEAQ ALLVLRRWQE MPGFGIQLVP
1681 EHVETRPLYH PHSPGLLQGS LHMWIDIFPQ DVPAPPPVDI KPRQPISYEL RVVIWNTEDV
1741 VLDDENPLTG EMSSDIYVKS WVKGLEHDKQ ETDVHFNSLT GEGNFNWRFV FRFDYLPTER
1801 EVSVWRRSGP FALEEAEFRQ PAVLVLQVWD YDRISANDFL GSLELQLPDM VRGARGPELC
```

Figure 3N-2

```
1861 SVQLARNGAG PRCNLFRCRR LRGWWPVVKL KEAEDGKVEA EFELLTVEEA EKRPVGKGRK
1921 QPEPLEKPSR PKTSFNWFVN PLKTFVFFIW RRYWRTLVLL LLVLLTVFLL LVFYTIPGQI
1981 SQVIFRPLHK
```

Figure 3O. Amino acid sequence of 158P2D3 v.17 (SEQ ID NO:50). The 158P3D2 v.17 protein has 2036 amino acids.

```
   1 MALTVSVQRL TGLTGTHDRQ VKLTFRGFTQ KTRKIHCGPE ADIGELFRWP HYGAPLAGEC
  61 LSVQVVNCSR VFSLRPLGTL VISLQQLQNA GHLVLREALV DENLQVSPIQ VELDLKYQPP
 121 EGATGAWSEE DFGAPIQDSF ELIIPNVGFQ ELEPGEAQLE RRAVALGRRL ARSLGQQDDE
 181 ENELELELEQ DLDDEPDVEL SGVMFSPLKS RARALAHGDP FQVSRAQDFQ VGVTVLEAQK
 241 LVGVNINPYV AVQVGGQRRV TATQRGTSCP FYNEYFLFEF HDTRLRLQDL LLEITVSGVG
 301 VTSVLQRRGD EKAAGLTPPS PKAFHSQTLP FMATRIGTFR MDLGIILDQP DGQFYQRWVP
 361 LHDPRDTRAG TKGFIKVTLS VRARGDLPPP MLPPAPGHCS DIEKNLLLPR GVPAERPWAR
 421 LRVRLYRAEG LPALRLGLLG SLVRALHDQR VLVEPYVRVS FLGQEGETSV SAEAAAPEWN
 481 EQLSFVELFP PLTRSLRLQL RDDAPLVDAA LATHVPDLRR ISHPGRAAGF NPTFGPAWVP
 541 LYGSPPGACL RDSLQGLNEG VGQGIWFRGR LLLAVSMQVL EGRAEPEPPQ AQQGSTLSRL
 601 TRKKKKKARR DQTPKAVPQH LDASPGAEGP EIPRAMEVEV EELLPLPENV LAPCEDFLLF
 661 GVLFEATMID PTVASQPISF EISIGRAGRL EEQLGRGSRA GEGTEGAAVE AQPLLGARPE
 721 EEKEEEELGT HAQRPEPMDG SGPYFCLPLC HCKPCMHVWS CWEDHTWRLQ SSNCVRKVAE
 781 RLDQGLQEVE RLQRKPGPGA CAQLKQALEV LVAGSRQFCH GAERRTMTRP NALDRCRGKL
 841 LVHSLNLLAK QGLRLLRCLR RRNVQKKVAL AKKLLAKLRF LAEEPQPPLP DVLVWMLSCQ
 901 RRVAWARIPA QDVLFSVVEE ERGRDCGKIQ SLMLTAPGAA PGEVCAKLEL FLRLGLGKQA
 961 KACTSELPPD LLPEPSAGLP SSLHRDDFSY FQLRAHLYQA RGVLAADDSG LSDPFARVLI
1021 STQCQTTRVL EQTLSPLWDE LLVFEQLIVD GRREHLQEEP PLVIINVFDH NKFGPPVFLG
1081 RALAAPRVKL MEDPYQRPEL QFFPLRKGPW AAGELIAAFQ LIELDYSGRL EPSVPSEVFP
1141 QDLAPLVEPH SGRLSLPPNV CPVLREFRVE VLFWGLRGLG RVHLLEVEQP QVVLEVAGQG
1201 VESEVLASYR ESPNFTELVR HLTVVFKDTA PLFHPQDLPE QPYLQPPLSI LVIERRAFGH
1261 TVLVGSHIVP HMLRFTFRGH EDPPEEEGEM EETGDMMPKG PQGQKSLDPF LAEAGISRQL
1321 LKPPLKKLPL GGLLNQGPGL EEDIPDPEEL DWGSKYYASL QELQGQHNFD EDEMDDPGDS
1381 DGVNLISMVG ETQDQGEAEV KGTVSPKKAV ATLKIYNRSL KEEFNHFEDW LNVFPLYRGQ
1441 GGQDGGGEEE GSGHLVGKFK GSFLIYPESE AVLFSEPQIS RGIPQNRPIK LLVRVYVVKA
1501 TNLAPADPNG KADPYVVVSA GREROQDTKER YIPKQLNPIF GEILELSISL PAETELTVAV
1561 FDHDLVGSDD LIGETHIDLE NRFYSHHRAN CGLASQYEVD GYNAWRDAFW PSQILAGLCQ
1621 RCGLPAPEYR AGAVKVGSKV FLTPPETLPP GSSSPTVASG DPEEAQALLV LRRWQEMPGF
1681 GIQLVPEHVE TRPLYHPHSP GLLQGSLHMW IDIFPQDVPA PPPVDIKPRQ PISYELRVVI
1741 WNTEDVVLDD ENPLTGEMSS DIYVKSWVKG LEHDKQETDV HFNSLTGEGN FNWRFVFRFD
1801 YLPTEREVSV WRRSGPFALE EAEFRQPAVL VLQVWDYDRI SANDFLGSLE LQLPDMVRGA
1861 RGPELCSVQL ARNGAGPRCN LFRCRRLRGW WPVVKLKEAE DVEREAQEAQ AGKKKRKQRR
```

Figure 3O-2

```
1921 RKGRPEDLEF TDMGGNVYIL TGKVEAEFEL LTVEEAEKRP VGKGRKQPEP LEKPSRPKTS
1981 FNWFVNPLKT FVFFIWRRYW RTLVLLLLVL LTVFLLLVFY TIPGQISQVI FRPLHK
```

Figure 3P. Amino acid sequence of 158P2D3 v.18 (SEQ ID NO:51). The 158P3D2 v.18 protein has 610 amino acids.

```
  1 MCKRRWHWPR SSWQNCAFWL RRHPGQPLVR SVPSWSSSCG WAWASKPRPA PLSCPRICCP
 61 SPQPGCPPAY TGTVLEQTLS PLWDELLVFE QLIVDGRREH LQEEPPLVII NVFDHNKFGP
121 PVFLGRALAA PRVKLMEDPY QRPELQFFPL RKGPWAAGEL IAAFQLIELD YSGRLEPSVP
181 SEVEPQDLAP LVEPHSGRLS LPPNVCPVLR EFRVEVLFWG LRGLGRVHLL EVEQPQVVLE
241 VAGQGVESEV LASYRESPNF TELVRHLTVV FKDTAPLFHP QDLPEQPYLQ PPLSILVIER
301 RAFGHTVLVG SHIVPHMLRF TFRGHEDPFE EEGEMEETGD MMPKGPQGQK SLDPFLAEAG
361 ISRQLLKHNF DEDEMDDPGD SDGVNLISMV GEIQDQGEAE VKGTVSPKKA VATLKIYNRS
421 LKEEFNHFED WLNVFPLYRG QGGQDGGGEE EGSGHLVGKF KGSFLIYPES EAVLFSEPQI
481 SRGIPQNRPI KLLVRVYVVK ATNLAPADPN GKADPYVVVS AGRERQDTKE RYIPKQLNPI
541 FGEILELSIS LPAETELTVA VFDHDLVGSD DLIGETHIDL ENRFYSHHRA NCGLASQYEV
601 WVQQGPQEPF
```

Figure 3Q. Amino acid sequence of 158P2D3 v.19 (SEQ ID NO:52). The 158P3D2 v.19 protein has 1978 amino acids.

```
   1 MALTVSVQRL TGLTGTHDRQ VKLTFRGFTQ KTRKIHCGPE ADIGELFRWP HYGAPLAGEC
  61 LSVQVVNCSR VFSLRPLGTL VISLQQLQNA GHLVLREALV DENLQVSPIQ VELDLKYQPP
 121 EGATGAWSEE DFGAPIQDSF ELIIPNVGFQ ELEPGEAQLE RRAVALGRRL ARSLGQQDDE
 181 ENELELELEQ DLDDEPDVEL SGVMFSPLKS RARALAHGDP FQVSRAQDFQ VGVTVLEAQK
 241 LVGVNINPYV AVQVGGQRRV TATQRGTSCP FYNEYFLFEF HDTRLRLQDL LLEITVSGVG
 301 VTSVLQRRGD EKAAGLTPPS PKAFHSQTLP FMATRICTFR MDLGIILDQP DGQFYQRWVP
 361 LHDPRDTRAG TKGFIKVTLS VRARGDLPPP MLPPAPGHCS DIEKNLLLPR GVPAERPWAR
 421 LRVRLYRAEG LPALRLGLLG SLVRALHDQR VLVEPYVRVS FLGQEGETSV SAEAAAPEWN
 481 EQLSFVELFP PLTRSLRLQL RDDAPLVDAA LATHVPDLRR ISHPGRAAGF NPTFGPAWVP
 541 LYGSPPGAGL RDSLQGLNEG VGQGIWFRGR LLLAVSMQVL EGRAEPEPPQ AQQGSTLSRL
 601 TRKKKKKARR DQTPKAVPQH LDASPGAEGP EIPRAMEVEV EELLPLPENV LAPCEDFLLF
 661 GVLFEATMID PTVASQPISF EISIGRAGRL EEQLGRGSRA GEGTEGAAVE AQPLLGARPE
 721 EEKEEEELGT HAQRPEPMDG SGPYFCLPLC HCKPCMHVWS CWEDHTWRLQ SSNCVRKVAE
 781 RLDQGLQEVE RLQRKPGPGA CAQLKQALEV LVAGSRQFCH GAERRTMTRP NALDRCRGKL
 841 LVHSLNLLAK QGLRLLRGLR RRNVQKKVAL AKKLLAKLRF LAEEPQPPLP DVLVWMLSGQ
 901 RRVAWARIPA QDVLFSVVEE ERGRDCGKIQ SLMLTAPGAA PGEVCAKLEL FLRLGLGKQA
 961 KACTSELPPD LLPEPSAGLP SSLHRDDFSY FQLRAHLYQA RGVLAADDSG LSDPFARVLI
1021 STQCQTTRVL EQTLSPLWDE LLVFEQLIVD GRREHLQEEP PLVIINVFDH NKFGPPVFLG
1081 RALAAPRVKL MEDPYQRPEL QFFPLRKGPW AAGELIAAFQ LIELDYSGRL EPSVPSEVEP
```

Figure 3Q-2

```
1141 QDLAPLVEPH SGRLSLPPNV CPVLREFRVE VLFWGLRGLG RVHLLEVEQP QVVLEVAGQG
1201 VESEVLASYR ESPNFTELVR HLTVDLPEQP YLQPPLSILV IERRAFGHTV LVGSHIVPHM
1261 LRFTFRGHED PPEEEGEMEE TGDMMPKGPQ GQKSLDPFLA EAGISRQLLK PPLKKLPLGG
1321 LLNQGPGLEE DIPDPEELDW GSKYYASLQE LQGQHNFDED EMDDPGDSDG VNLISMVGEI
1381 QDQGEAEVKG TVSPKKAVAT LKIYNRSLEE EFNHFEDWLN VFPLYRGQGG QDGGGEEEGS
1441 GHLVGKFKGS FLIYPESEAV LFSEPQISRG IPQNRPIKLL VRVYVVKATN LAPADPNGKA
1501 DPYVVVSAGR ERQDTKERYI PKQLNPIFGE ILELSISLPA ETELTVAVFD HDLVGSDDLI
1561 GETHIDLENR FYSHHRANCG LASQYEVDGY NAWRDAFWPS QILAGLCQRC GLPAPEYRAG
1621 AVKVGSKVFL TPPETLPPVA SGDPEEAQAL LVLRRWQEMP GFGIQLVPEH VETRPLYHPH
1681 SPGLLQGSLH MWIDIFPQDV PAPPPVDIKP RQPISYELRV VIWNTEDVVL DDENPLTGEM
1741 SSDIYVKSWV KGLEHDKQET DVHFNSLTGE GNFNWRFVFR FDYLPTEREV SVWRRSGPFA
1801 LEEAEFRQPA VLVLQVWDYD RISANDFLGS LELQLPDMVR GARGPELCSV QLARNGAGPR
1861 CNLFRCRRLR GWWPVVKLKE AEDGKVEAEF ELLTVEEAEK RPVGKGRKQP EPLEKPSRPK
1921 TSFNWFVNPL KTFVFFIWRR YWRTLVLLLL VLLTVFLLLV FYTIPGQISQ VIFRPLHK
```

Figure 3R. Amino acid sequence of 158P2D3 v.20 (SEQ ID NO:53). The 158P3D2 v.20 protein has 2018 amino acids.

```
   1 MALTVSVQRL TGLTGTHDRQ VKLTFRGFTQ KTRKIHCGPE ADIGELFRWP HYGAPLAGEC
  61 LSVQVVNCSR VFSLRPLGTL VISLQQLQNA GHLVLREALV DENLQVSPIQ VELDLKYQPP
 121 EGATGAWSEE DFGAPIQDSF ELIIPNVGFQ ELEPGEAQLE RRAVALGRRL ARSLGQQDDE
 181 ENELELELEQ DLDDEPDVEL SGVMFSPLKS RARALAHGDP FQVSRAQDFQ VGVTVLEAQK
 241 LVGVNINPYV AVQVGGQRRV TATQRGTSCP FYNEYFLFEF HDTRLRLQDL LLEITVSGVG
 301 VTSVLQRRGD EKAAGLTPPS PKAFHSQTLP FMATRIGTFR MDLGIILDQP DGQFYQRWVP
 361 LHDPRDTRAG TKGFIKVTLS VRARGDLPPP MLPPAPGHCS DIEKNLLLPR GVPAERPWAR
 421 LRVRLYRAEG LPALRLGLLG SLVRALHDQR VLVEPYVRVS FLGQEGETSV SAEAAAPEWN
 481 EQLSFVELFP PLTRSLRLQL RDDAPLVDAA LATHVPDLRR ISHPGRAAGF NPTFGPAWVP
 541 LYGSPPGAGL RDSLQGLNEG VGQGIWFRGR LLLAVSMQVL EGRAEPEPPQ AQQGSTLSRL
 601 TRKKKKKARR DQTPKAVPQH LDASPGAEGP EIPRAMEVEV EELLPLPENV LAPCEDFLLF
 661 GVLFEATMID PTVASQPISF EISIGRAGRL EEQLGRGSRA GEGTEGAAVE AQPLLGARPE
 721 EEKEEEELGT HAQRPEPMDG SGPYFCLPLC HCKPCMHVWS CWEDHTWRLQ SSNCVRKVAE
 781 RLDQGLQEVE RLQRKPGPGA CAQLKQALEV LVAGSRQFCH GAERRTMTRP NALDRCRGKL
 841 LVHSLNLLAK QGLRLLRGLR RRNVQKKVAL AKKLLAKLRF LAEEPQPPLP DVLVWMLSGQ
 901 RRVAWARIPA QDVLFSVVEE ERGRDCGKIQ SLMLTAPGAA PGEVCAKLEL FLRLGLGKQA
 961 KACTSELPPD LLPEPSAGLP SSLHRDDFSY FQLRAHLYQA RGVLAADDSG LSDPFARVLI
1021 STQCQTTRVL EQTLSPLWDE LLVFEQLIVD GRREHLQFEP PLVIINVFDH NKFGPPVFLG
1081 RALAAPRVKL MEDPYQRPEL QFFPLRKCPW AACELIAAFQ LIELDYSGRL EPSVPSEVEP
1141 QDLAPLVEPH SGRLSLPPNV CPVLREFRVE VLFWGLRGLG RVHLLEVEQP QVVLEVAGQG
1201 VESEVLASYR ESPNFTELVR HLTVDLPEQP YLQPPLSILV IERRAFGHTV LVGSHIVPHM
```

Figure 3R-2

```
1261 LRFTFRGHED PPEEEGEMEE TGDMMPKGPQ GQKSLDPFLA EAGISRQLLK PPLKKLPLGG
1321 LLNQGPGLEE DIPDPEELDW GSKYYASLQE LQGQHNFDED EMDDPGDSDG VNLISMVGEI
1381 QDQGEAEVKG TVSPKKAVAT LKIYNRSLEE EFNHFEDWLN VFPLYRGQGG QDGGGEEEGS
1441 GHLVGKFKGS FLIYPESEAV LFSEPQISRG IPQNRPIKLL VRVYVVKATN LAPADPNGKA
1501 DPYVVVSAGR ERQDTKERYI PKQLNPIFGE ILELSISLPA ETELTVAVFD HDLVGSDDLI
1561 GETHIDLENR FYSHHRANCG LASQYEVDGY NAWRDAFWPS QILAGLCQRC GLPAPEYRAG
1621 AVKVGSKVFL TPPETLPPVA SGDPEEAQAL LVLRRWQEMP GFGIQLVPEH VETRPLYHPH
1681 SPGLLQGSLH MWIDIFPQDV PAPPPVDIKP RQPISYELRV VIWNTEDVVL DDENPLTGEM
1741 SSDIYVKSWV KGLEHDKQET DVHFNSLTGE GNFNWRFVFR FDYLPTEREV SVWRRSGPFA
1801 LEEAEFRQPA VLVLQVWDYD RISANDFLGS LELQLPDMVR GARGPELCSV QLARNGAGPR
1861 CNLFRCRRLR GWWPVVKLKE AEDVEREAQE AQAGKKKRKQ RRRKGRPEDL EFTDMGGNVY
1921 ILTGKVEAEF ELLTVEEAEK RPVGKGRKQP EPLEKPSRPK TSFNWFVNPL KTFVFFIWRR
1981 YWRTLVLLLL VLLTVFLLLV FYTIPGQTSQ VIFRPLHK
```

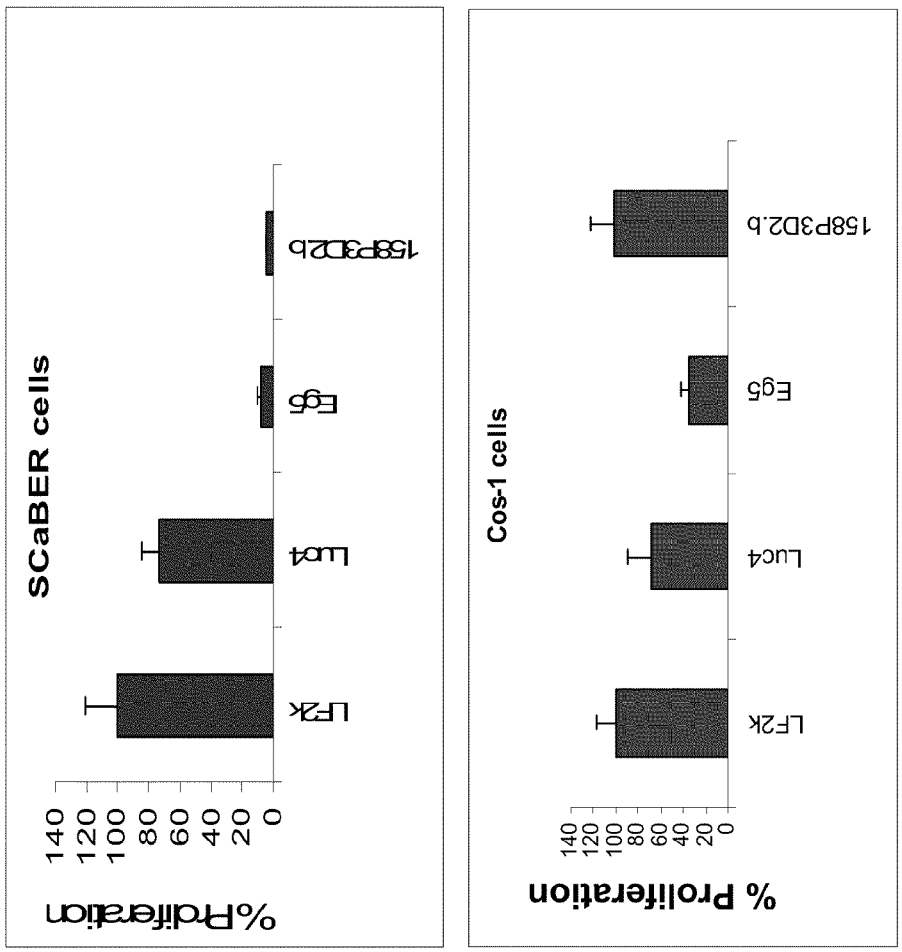
Figure 4: Effect of 158P3D2 RNAi on cell proliferation

Figure 5a: 158P3D2 variant 1 Hydrophilicity profile
(Hopp T.P., Woods K.R., 1981.
Proc. Natl. Acad. Sci. U.S.A. 78:3824-3828)
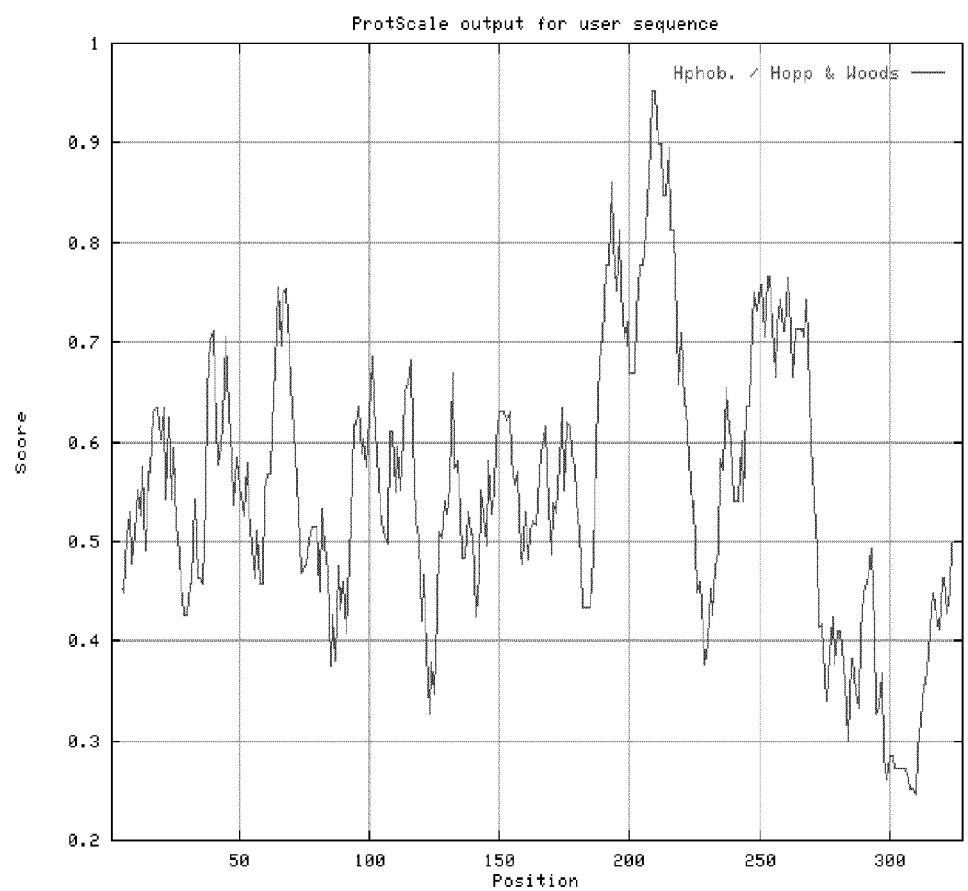

Figure 5b: 158P3D2 variant 2a
Hydrophilicity profile
(Hopp T.P., Woods K.R., 1981.
Proc. Natl. Acad. Sci. U.S.A. 78:3824-3828)
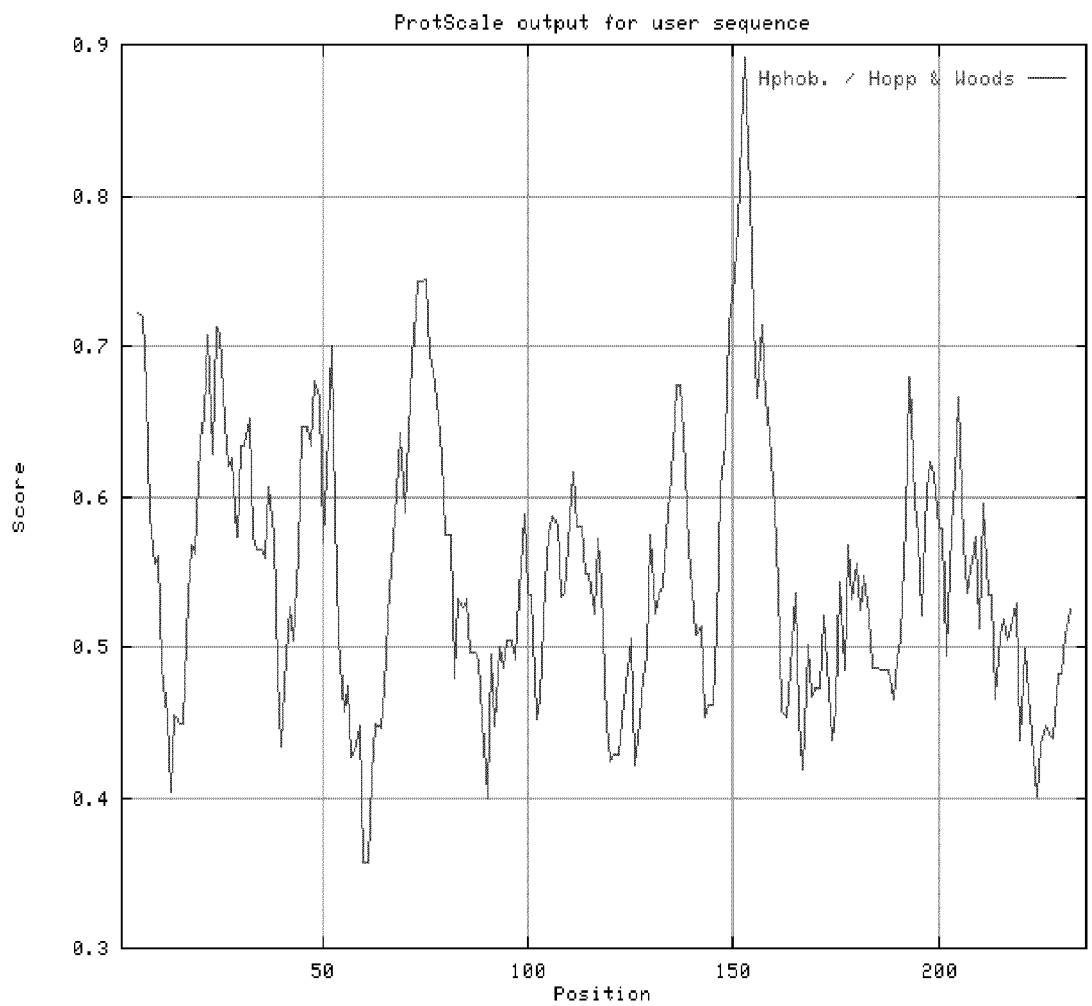

Figure 5c: 158P3D2 variant 2b
Hydrophilicity profile
(Hopp T.P., Woods K.R., 1981.
Proc. Natl. Acad. Sci. U.S.A. 78:3824-3828)
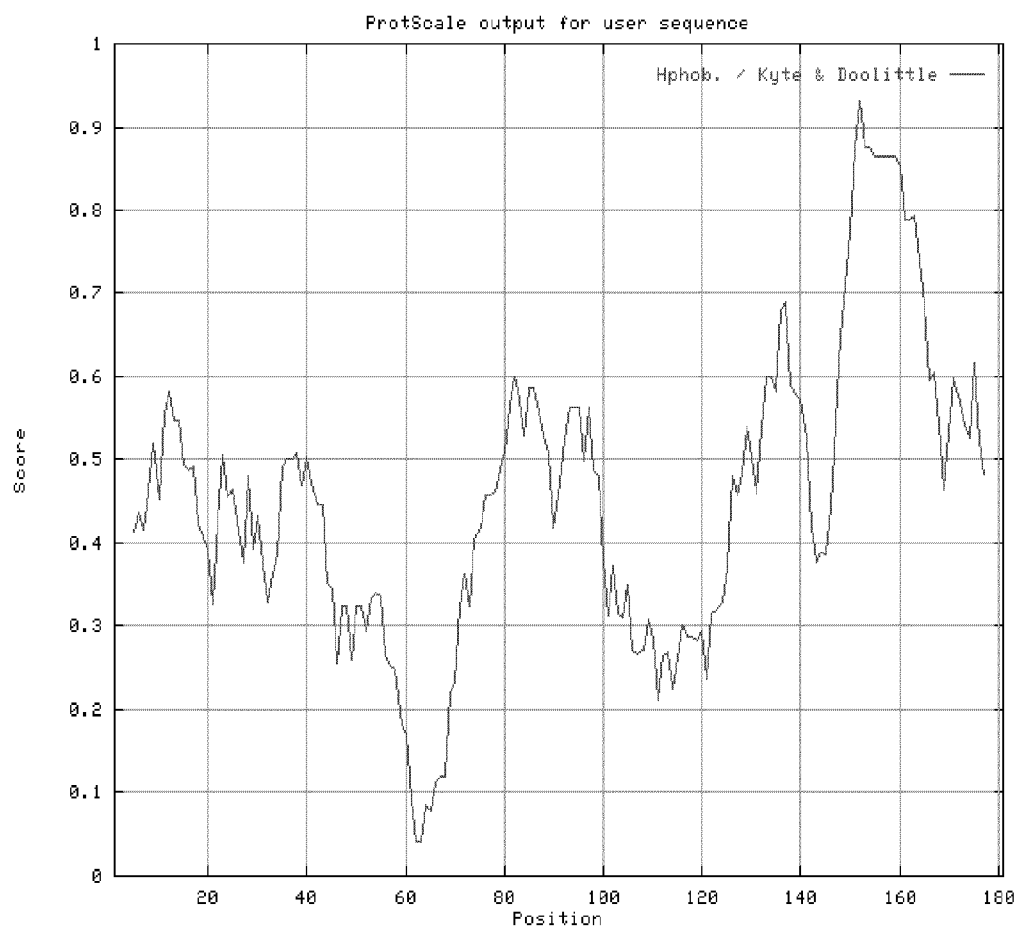

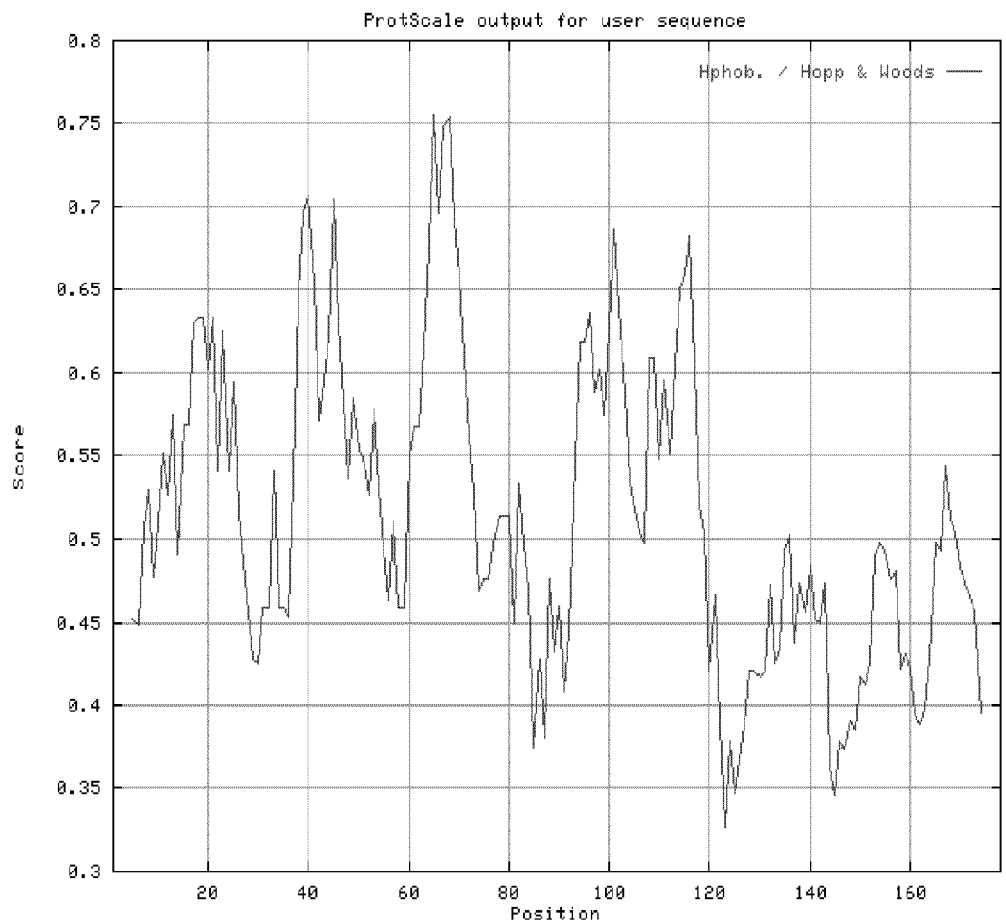
Figure 5d: 158P3D2 variant 5a
Hydrophilicity profile
(Hopp T.P., Woods K.R., 1981.
Proc. Natl. Acad. Sci. U.S.A. 78:3824-3828)

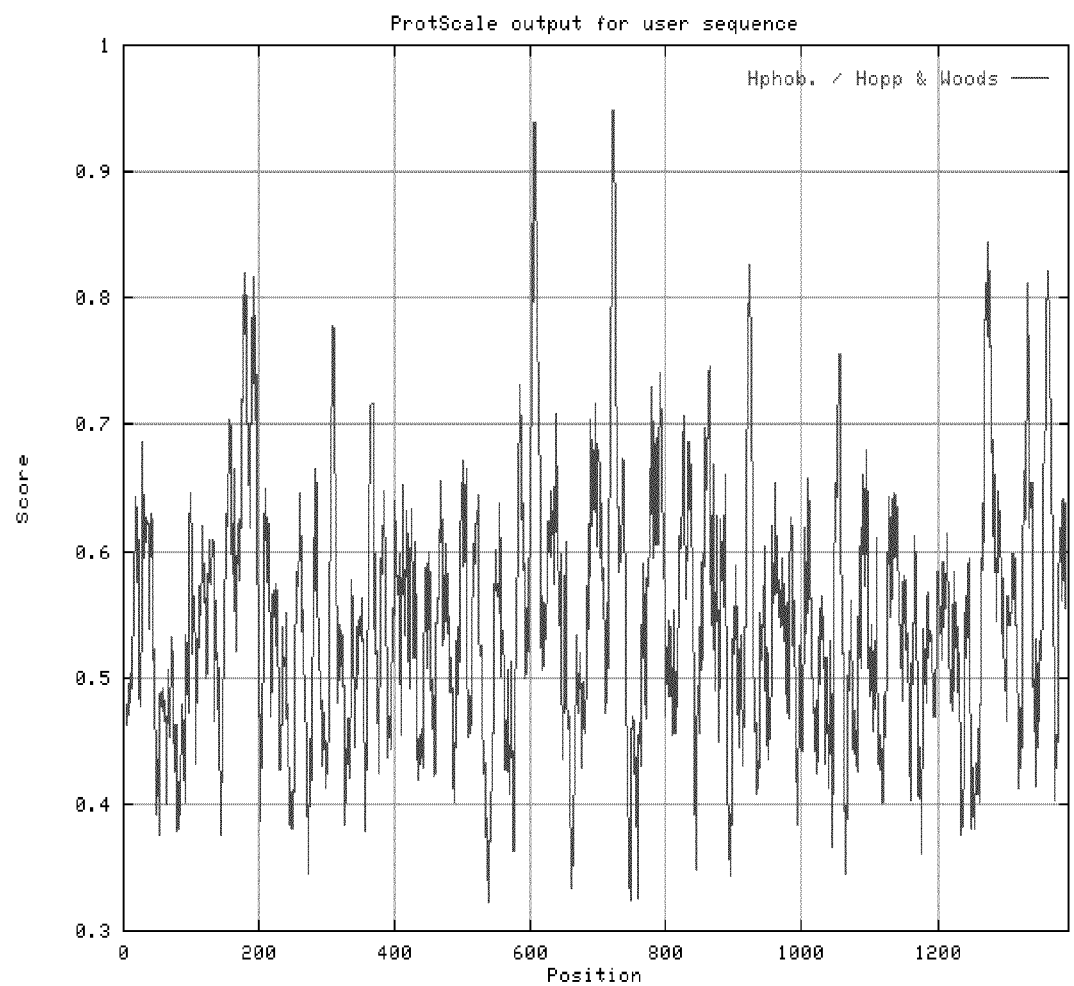
Figure 5e: 158P3D2 variant 14
Hydrophilicity profile
(Hopp T.P., Woods K.R., 1981.
Proc. Natl. Acad. Sci. U.S.A. 78:3824-3828)

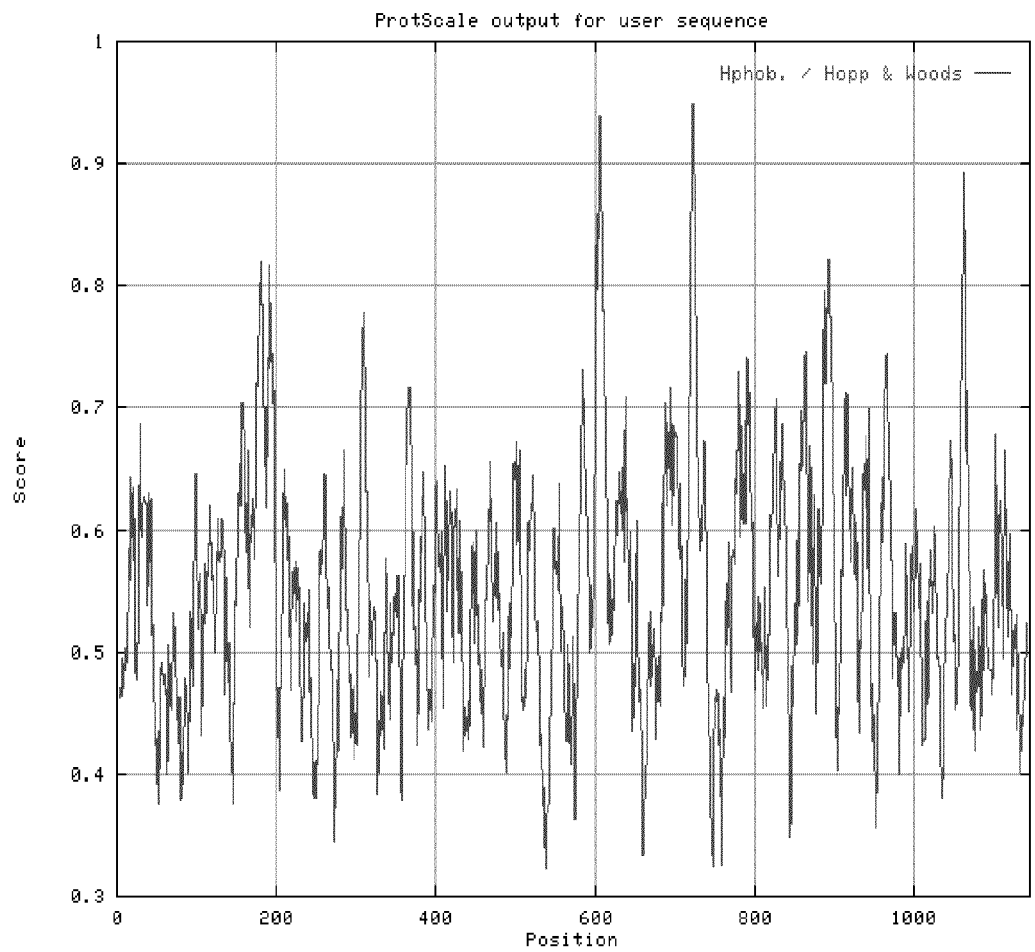
Figure 5f: 158P3D2 variant 15
Hydrophilicity profile
(Hopp T.P., Woods K.R., 1981.
Proc. Natl. Acad. Sci. U.S.A. 78:3824-3828)

Figure 5g: 158P3D2 variant 16
Hydrophilicity profile
(Hopp T.P., Woods K.R., 1981.
Proc. Natl. Acad. Sci. U.S.A. 78:3824-3828)
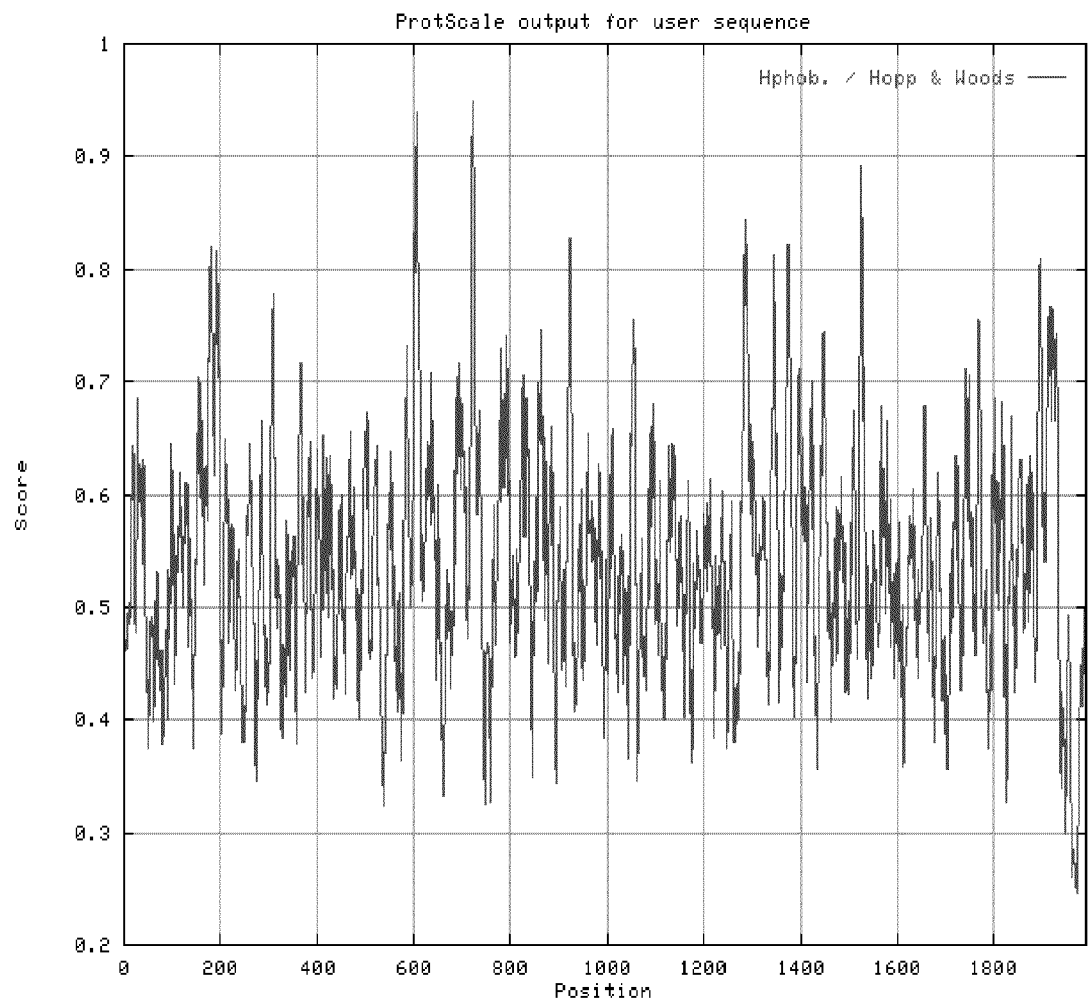

Figure 5h: 158P3D2 variant 17
Hydrophilicity profile
(Hopp T.P., Woods K.R., 1981.
Proc. Natl. Acad. Sci. U.S.A. 78:3824-3828)
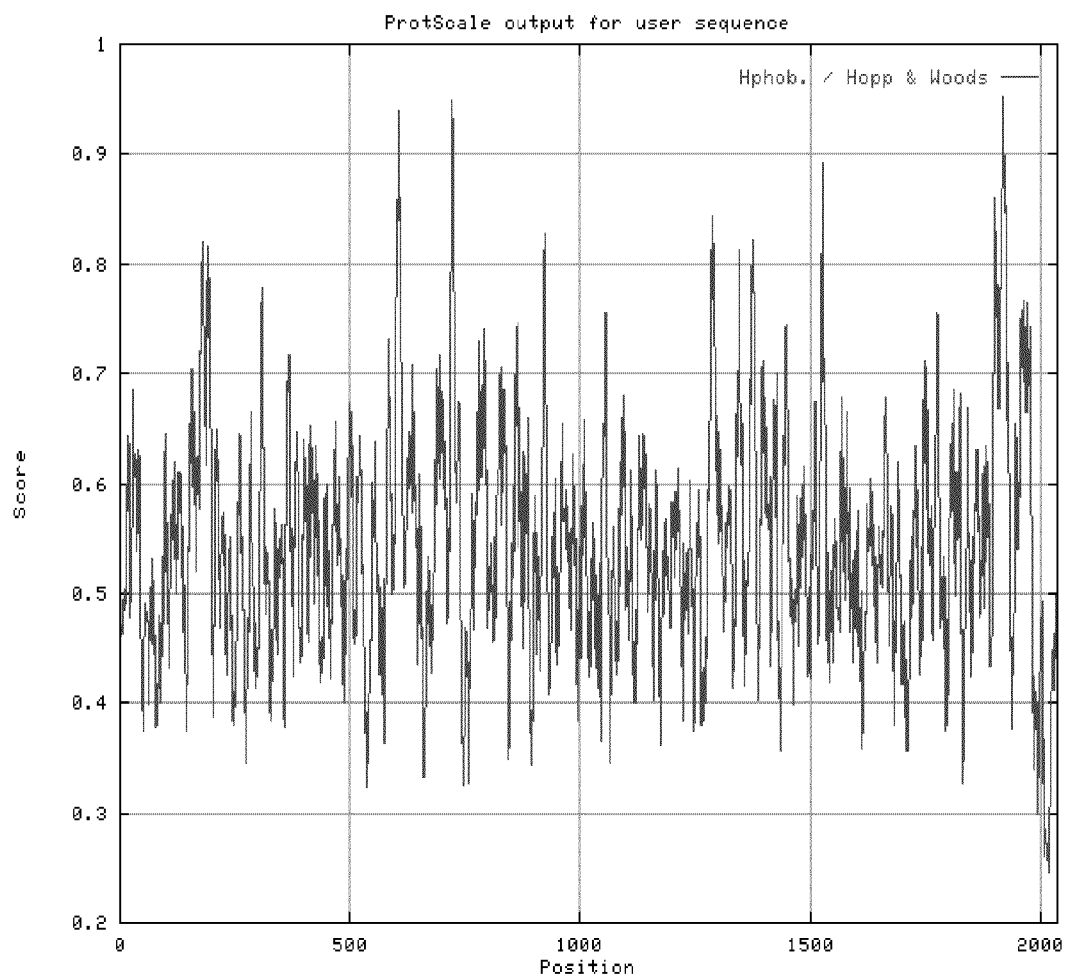

Figure 5i: 158P3D2 variant 18
Hydrophilicity profile
(Hopp T.P., Woods K.R., 1981.
Proc. Natl. Acad. Sci. U.S.A. 78:3824-3828)
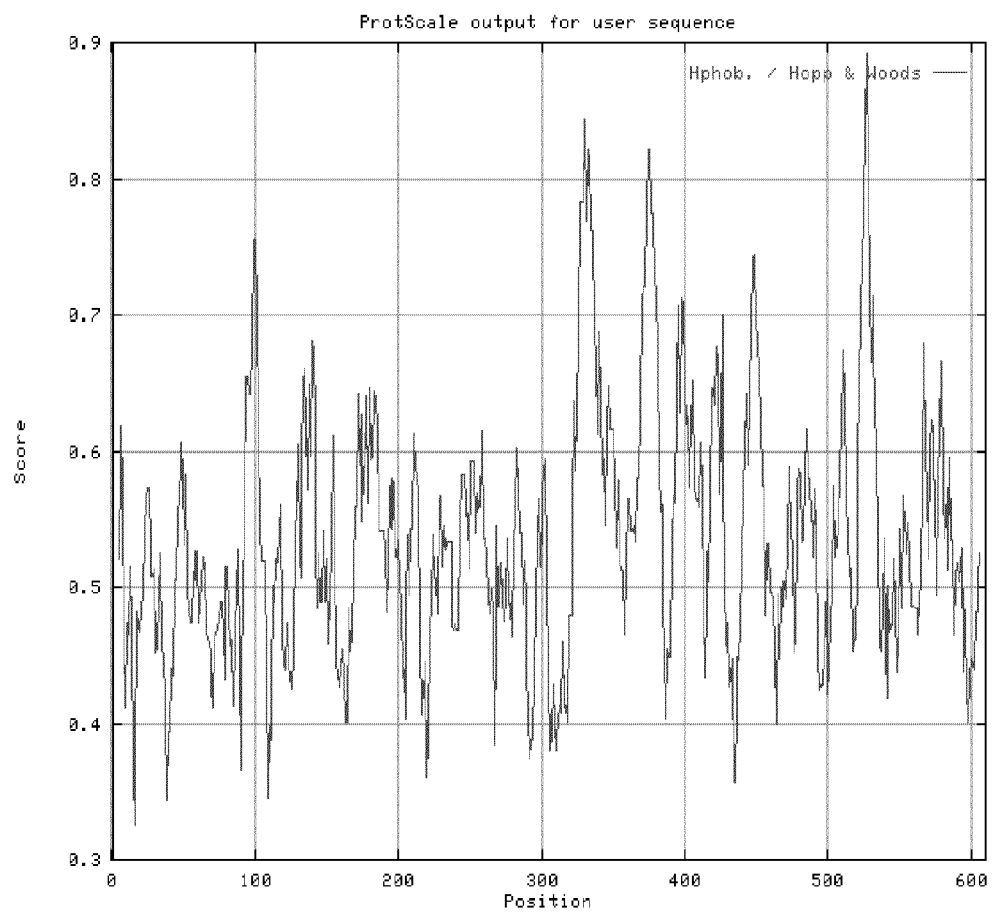

Figure 6a: 158P3D2 variant 1
Hydropathicity Profile
(Kyte J., Doolittle R.F., 1982. J. Mol. Biol. 157:105-132)
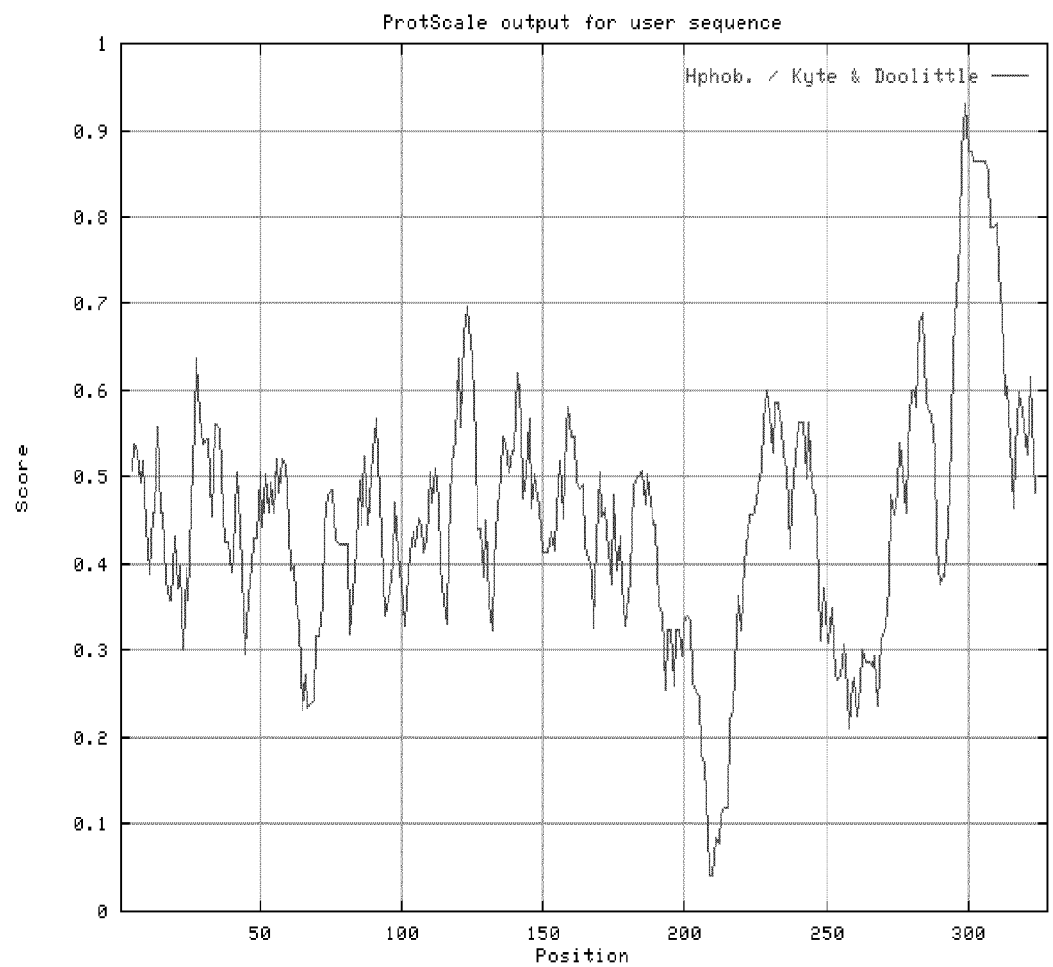

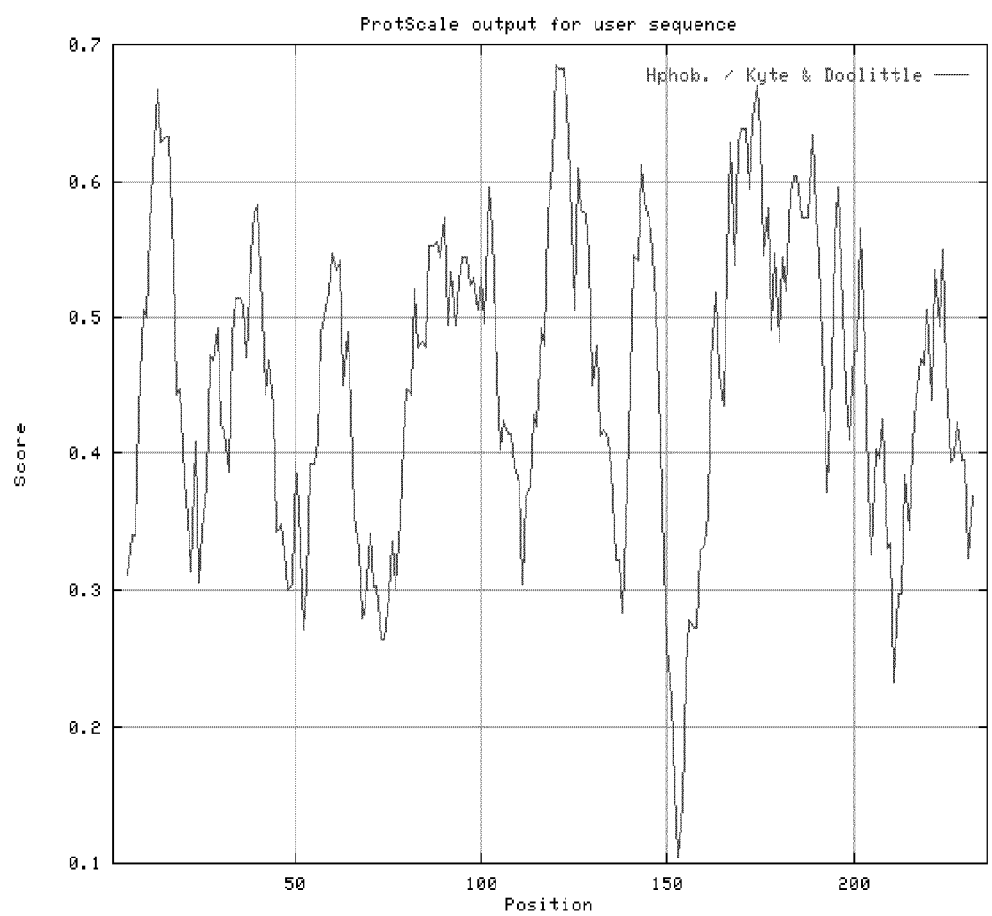
Figure 6b: 158P3D2 variant 2a
Hydropathicity Profile
(Kyte J., Doolittle R.F., 1982. J. Mol. Biol. 157:105-132)

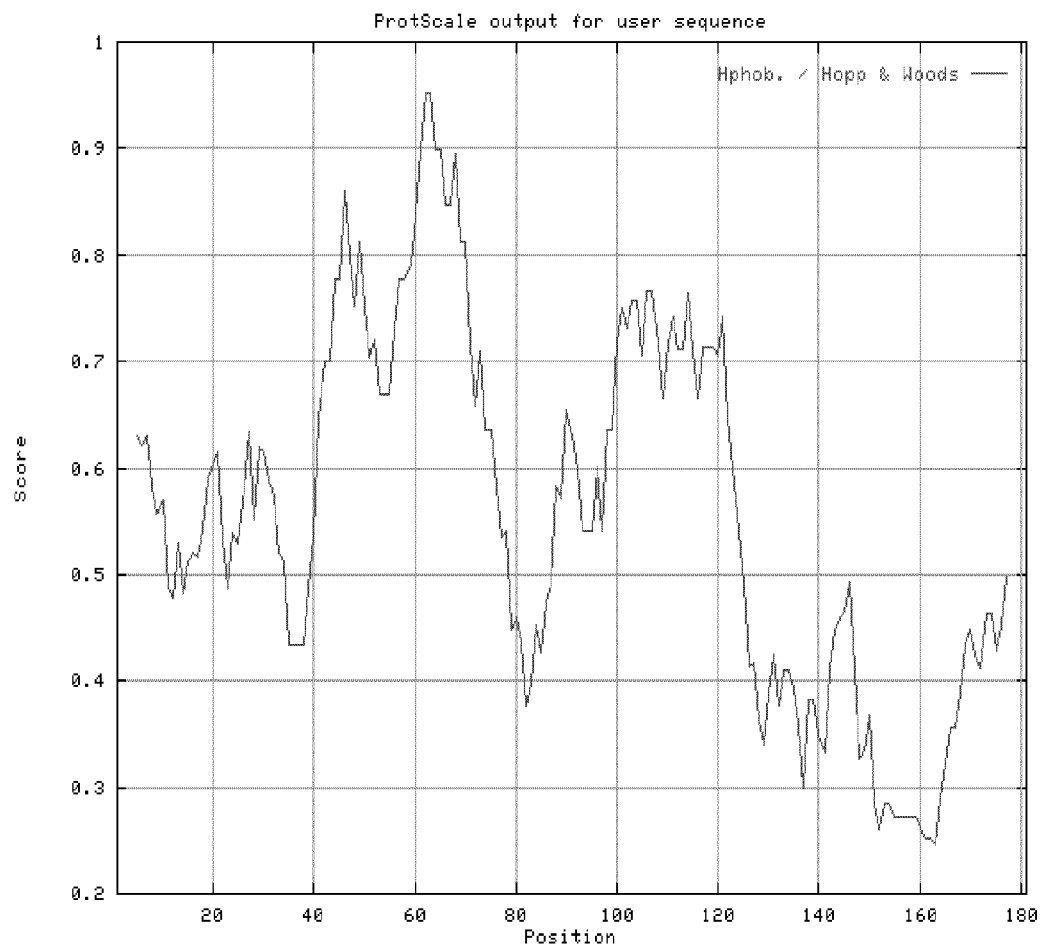
Figure 6c:158P3D2 variant 2b
Hydropathicity Profile
(Kyte J., Doolittle R.F., 1982. J. Mol. Biol. 157:105-132)

Figure 6d: 158P3D2 variant 5a
Hydropathicity Profile
(Kyte J., Doolittle R.F., 1982. J. Mol. Biol. 157:105-132)
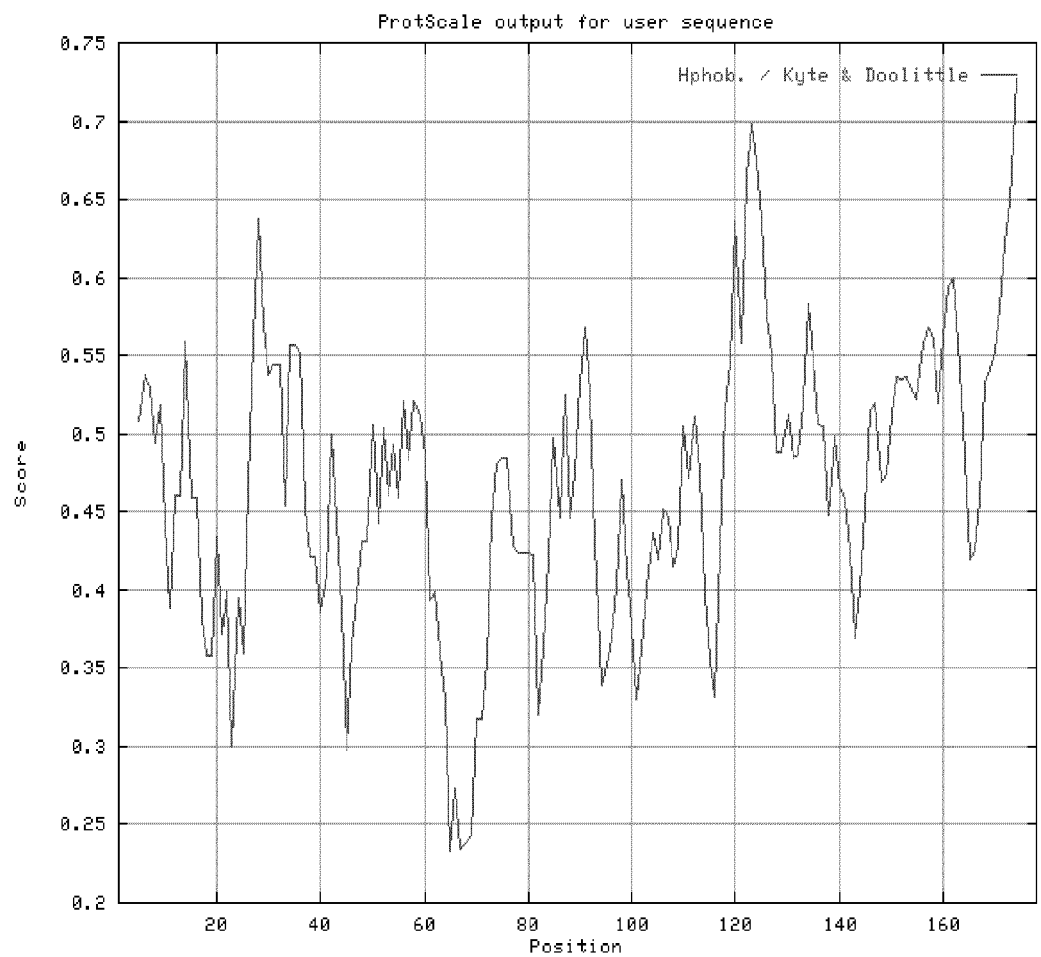

Figure 6e: 158P3D2 variant 14
Hydropathicity Profile
(Kyte J., Doolittle R.F., 1982. J. Mol. Biol. 157:105-132)
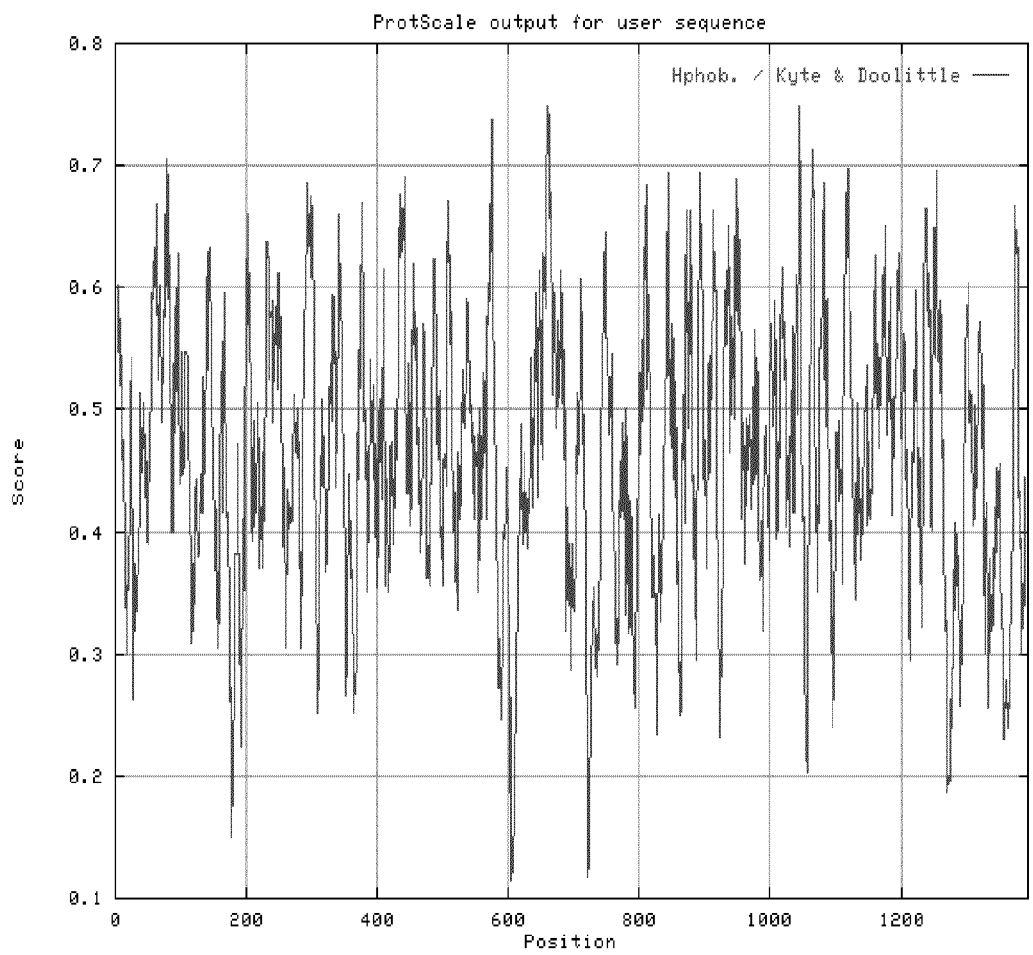

Figure 6f: 158P3D2 variant 15 Hydropathicity Profile
(Kyte J., Doolittle R.F., 1982. J. Mol. Biol. 157:105-132)
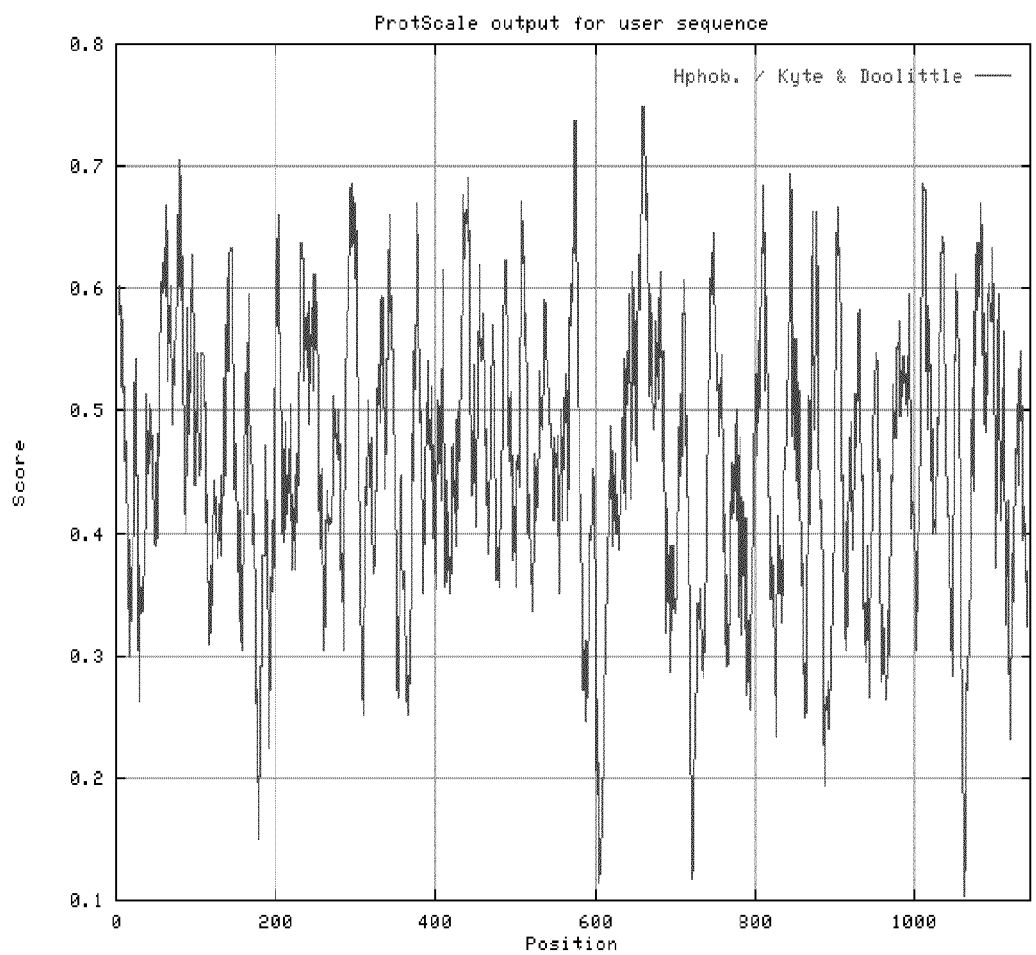

Figure 6g: 158P3D2 variant 16
Hydropathicity Profile
(Kyte J., Doolittle R.F., 1982. J. Mol. Biol. 157:105-132)
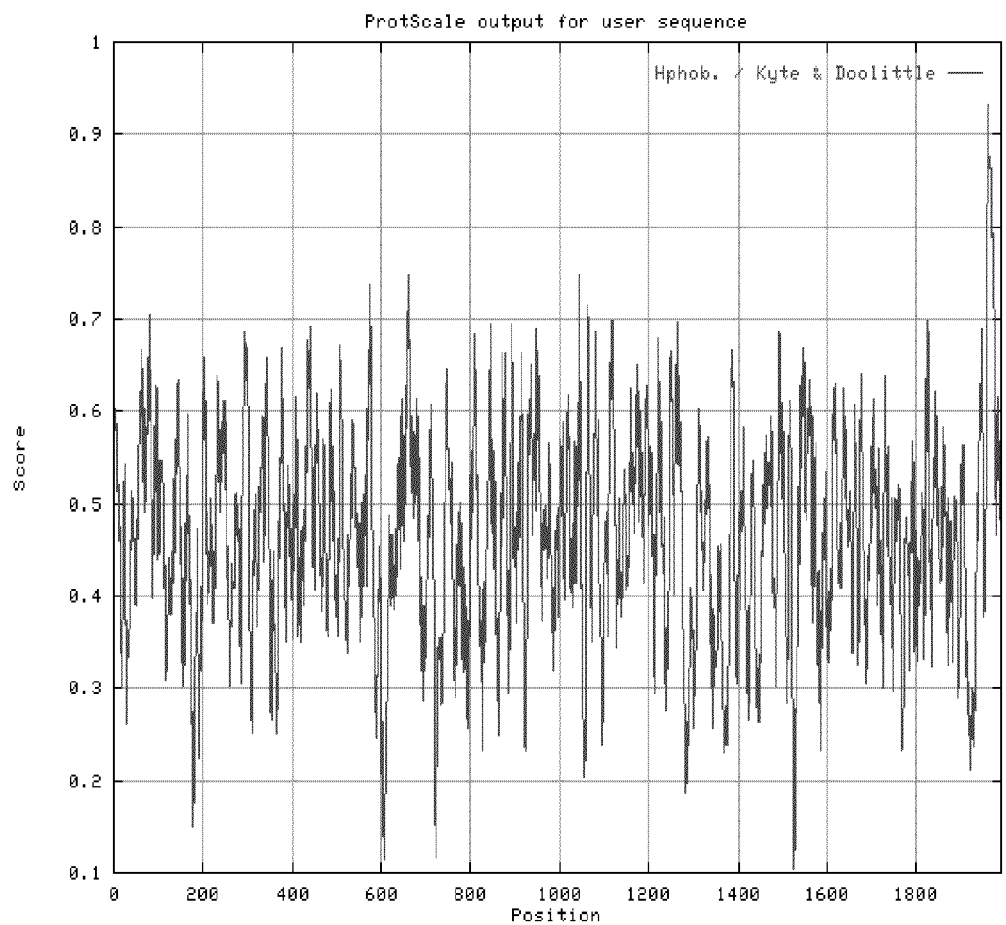

Figure 6h: 158P3D2 variant 17
Hydropathicity Profile
(Kyte J., Doolittle R.F., 1982. J. Mol. Biol. 157:105-132)
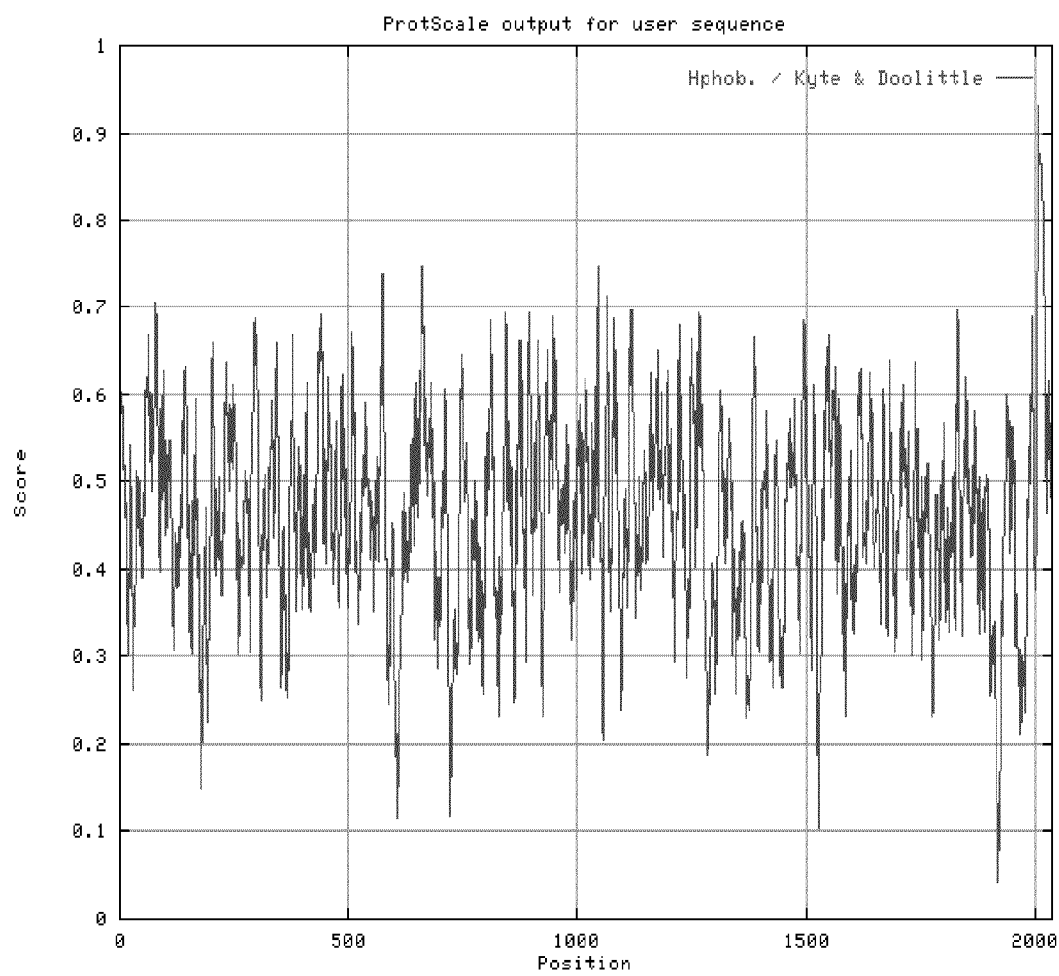

Figure 6i: 158P3D2 variant 18
Hydropathicity Profile
(Kyte J., Doolittle R.F., 1982. J. Mol. Biol. 157:105-132)
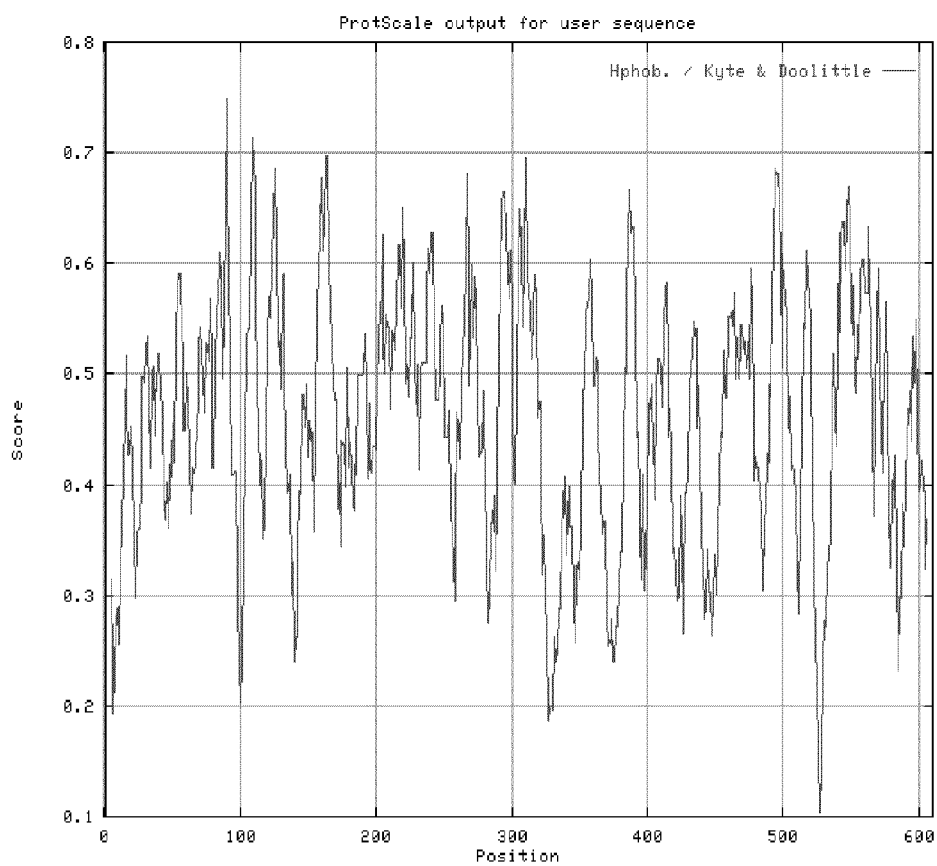

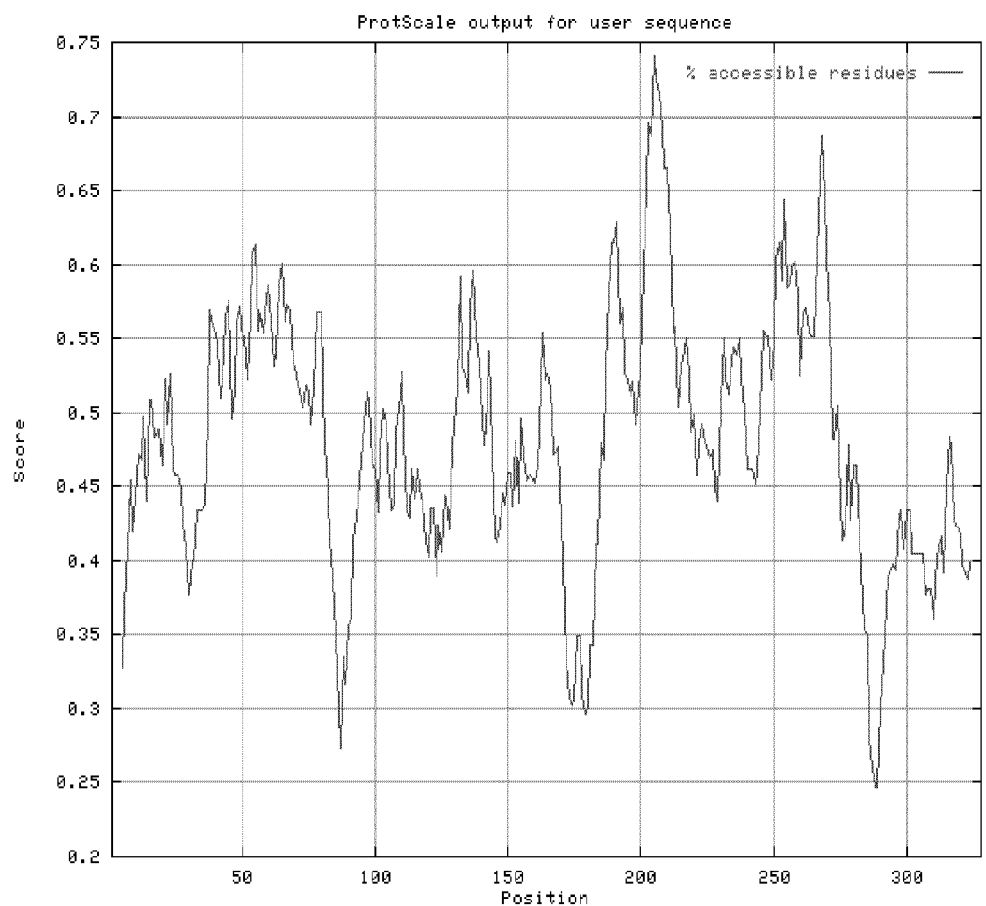
Figure 7a:158P3D2 variant 1
% Accessible Residues Profile
(Janin J., 1979. Nature 277:491-492)

Figure 7b: 158P3D2 variant 2a
% Accessible Residues Profile
(Janin J., 1979. Nature 277:491-492)
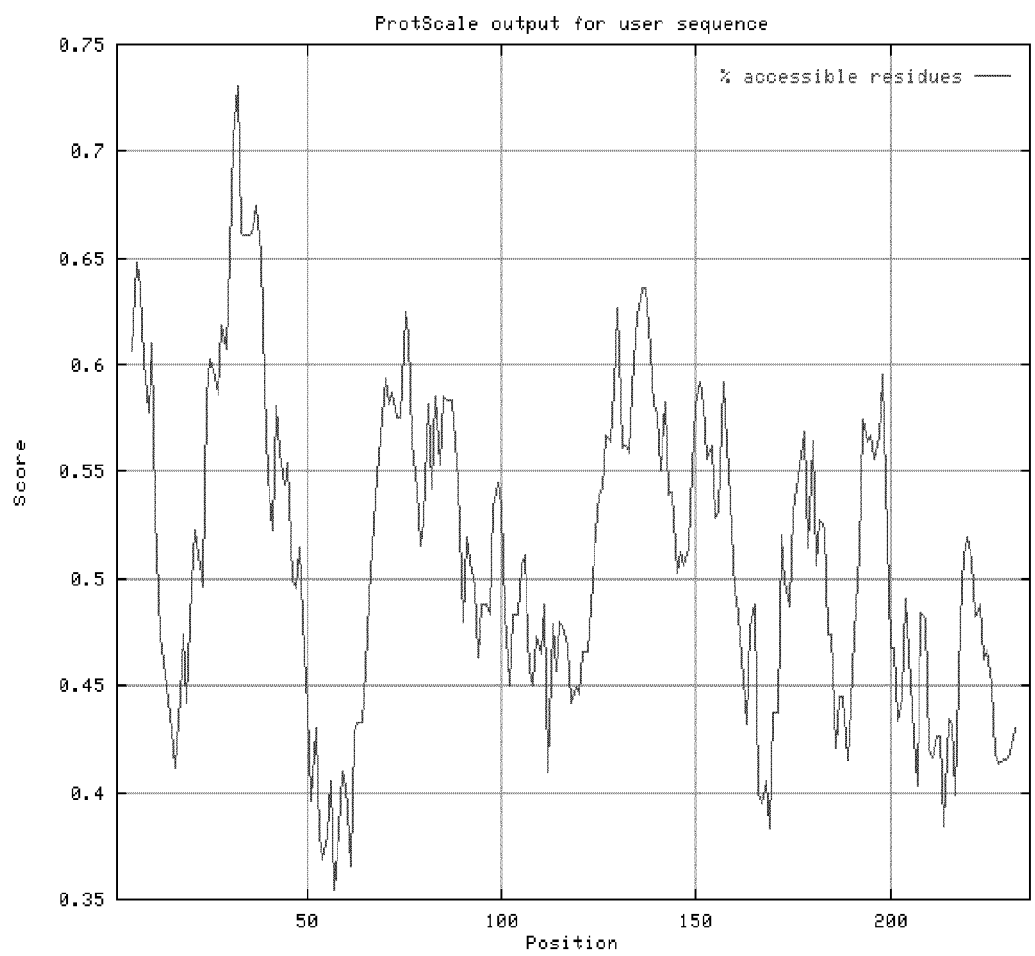

Figure 7c: 158P3D2 variant 2b
% Accessible Residues Profile
(Janin J., 1979. Nature 277:491-492)
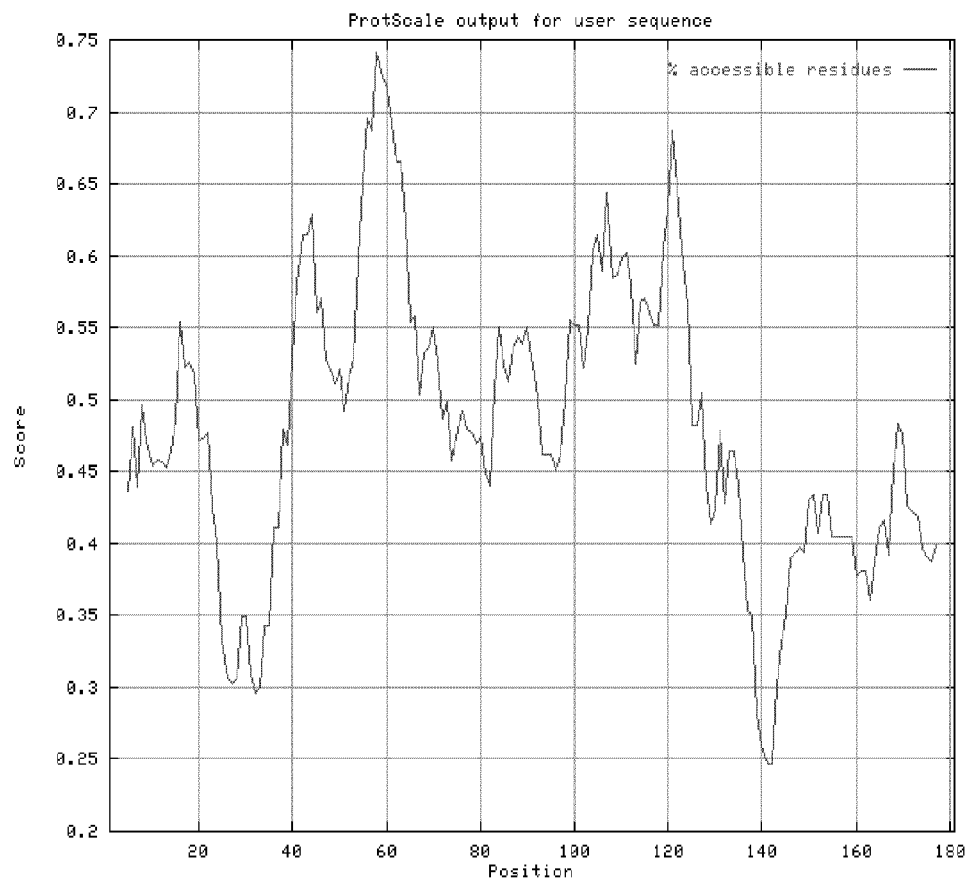

Figure 7d:158P3D2 variant 5a
% Accessible Residues Profile
(Janin J., 1979. Nature 277:491-492)
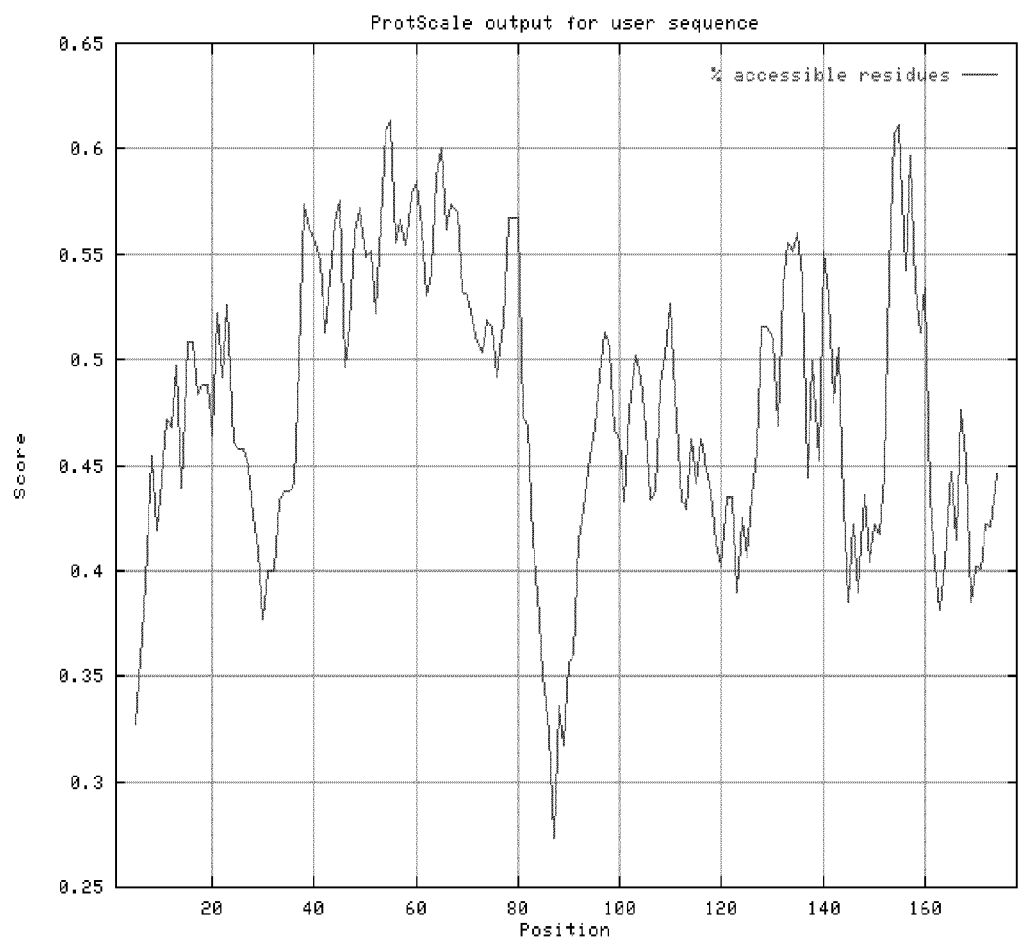

Figure 7e: 158P3D2 variant 14
% Accessible Residues Profile
(Janin J., 1979. Nature 277:491-492)
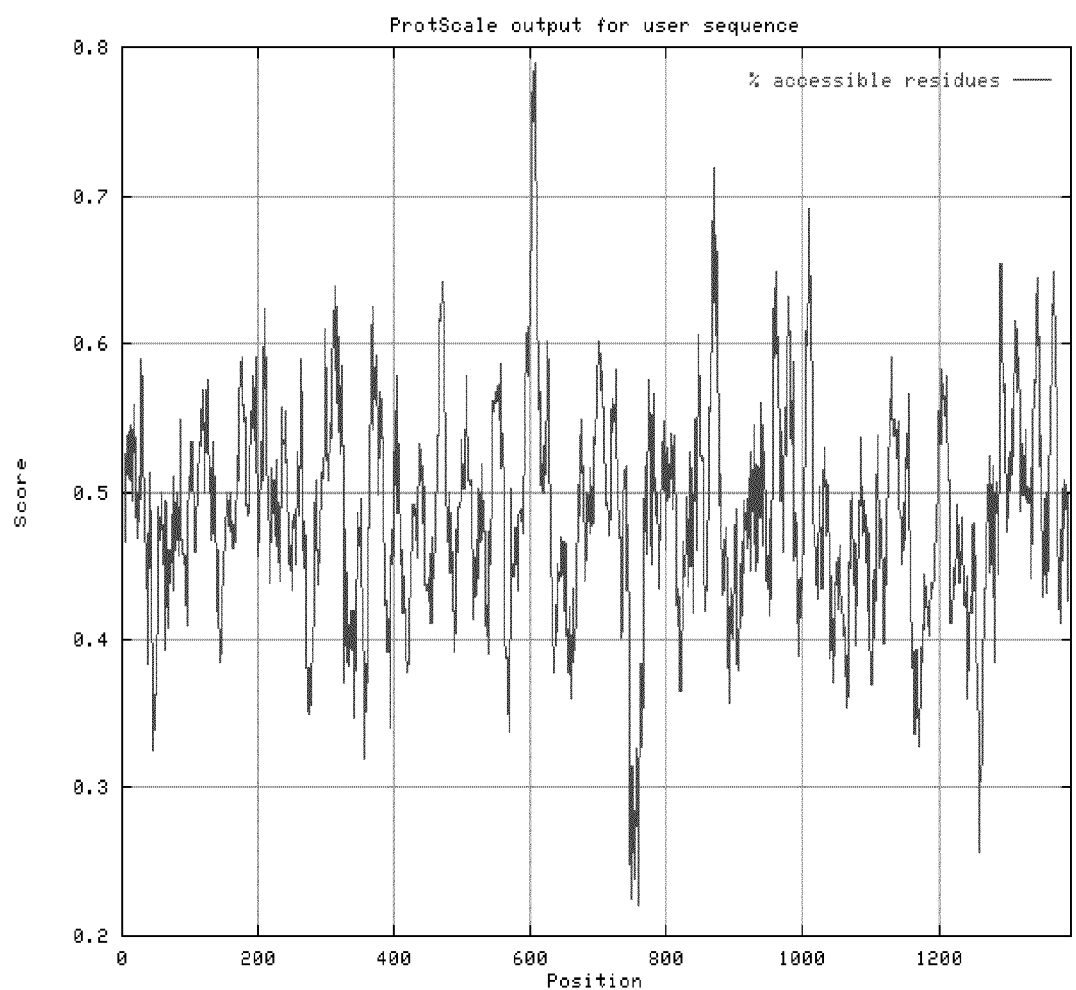

Figure 7f: 158P3D2 variant 15
% Accessible Residues Profile
(Janin J., 1979. Nature 277:491-492)
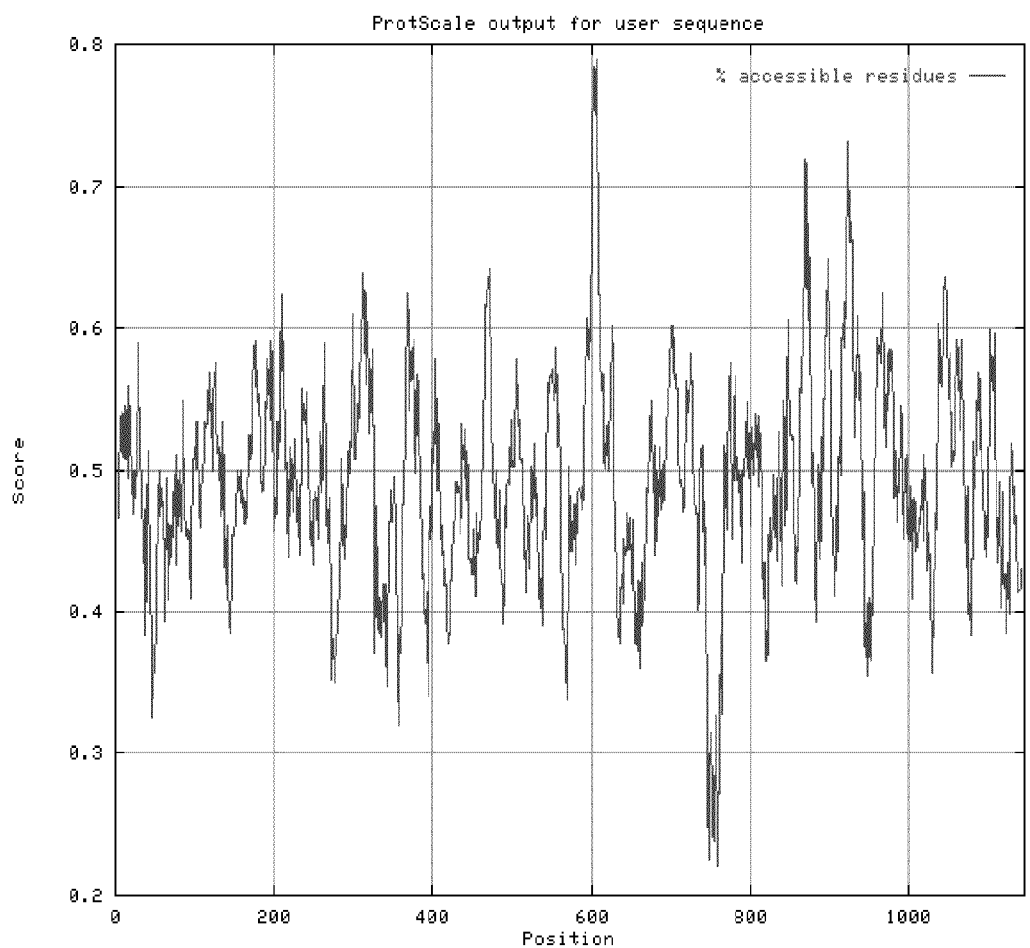

Figure 7g: 158P3D2 variant 16
% Accessible Residues Profile
(Janin J., 1979. Nature 277:491-492)
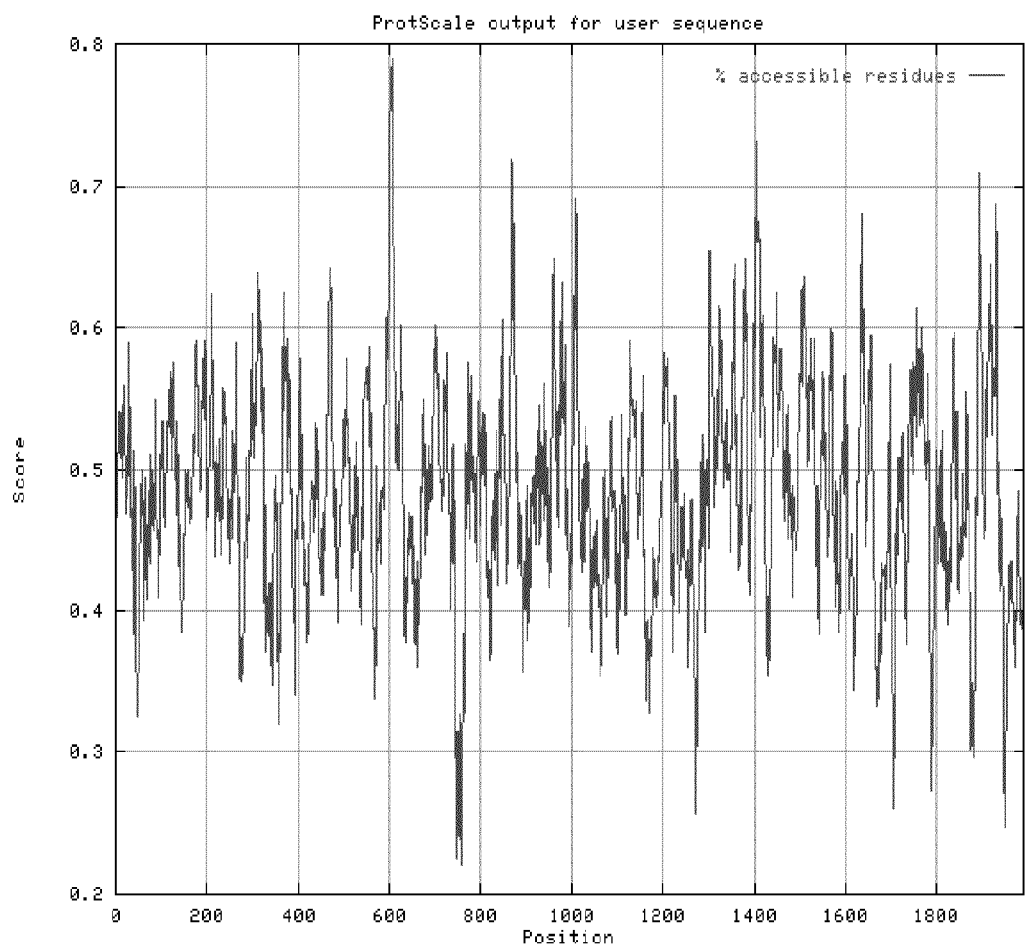

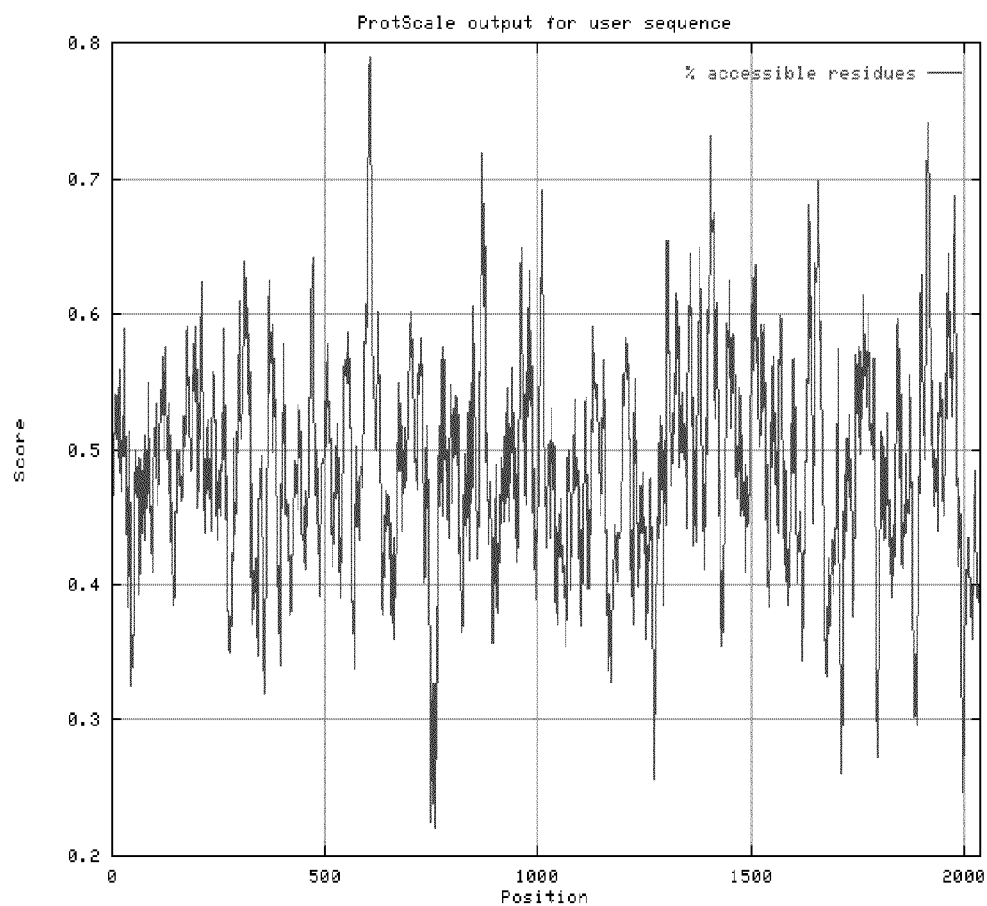
Figure 7h: 158P3D2 variant 17
% Accessible Residues Profile
(Janin J., 1979. Nature 277:491-492)

Figure 7i: 158P3D2 variant 18
% Accessible Residues Profile
(Janin J., 1979. Nature 277:491-492)
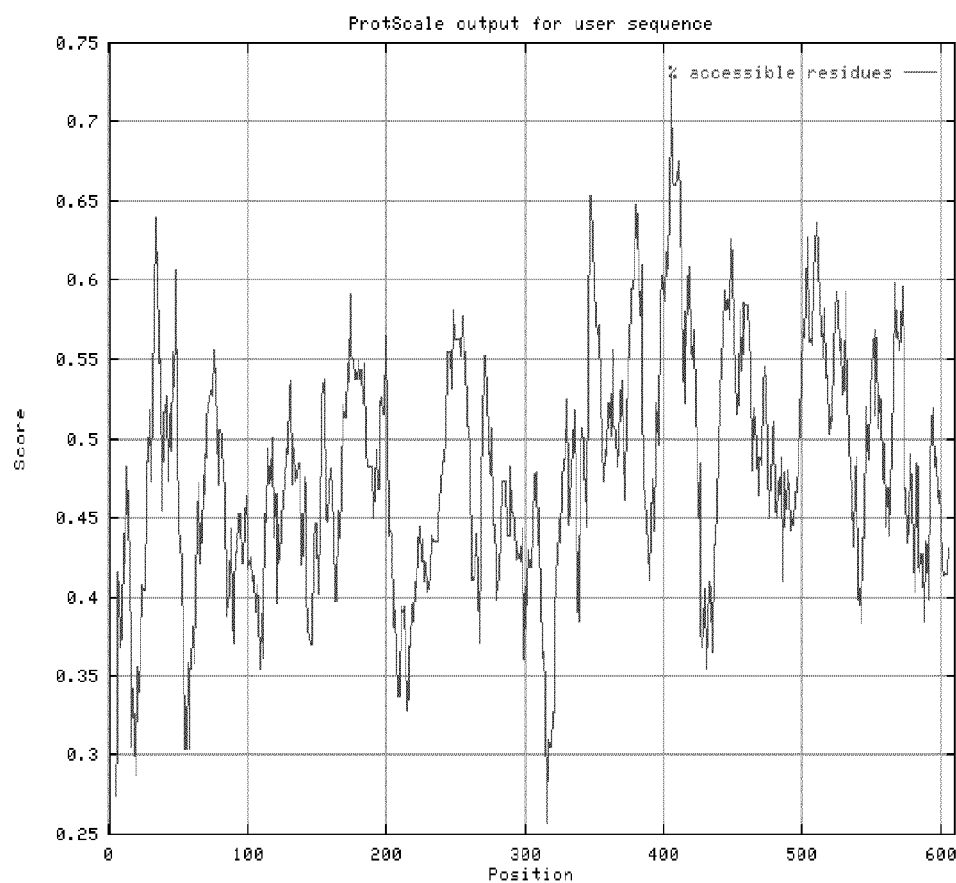

Figure 8a:158P3D2 variant 1
Average Flexibility Profile
(Bhaskaran R., Ponnuswamy P.K., 1988.
Int. J. Pept. Protein Res. 32:242-255)
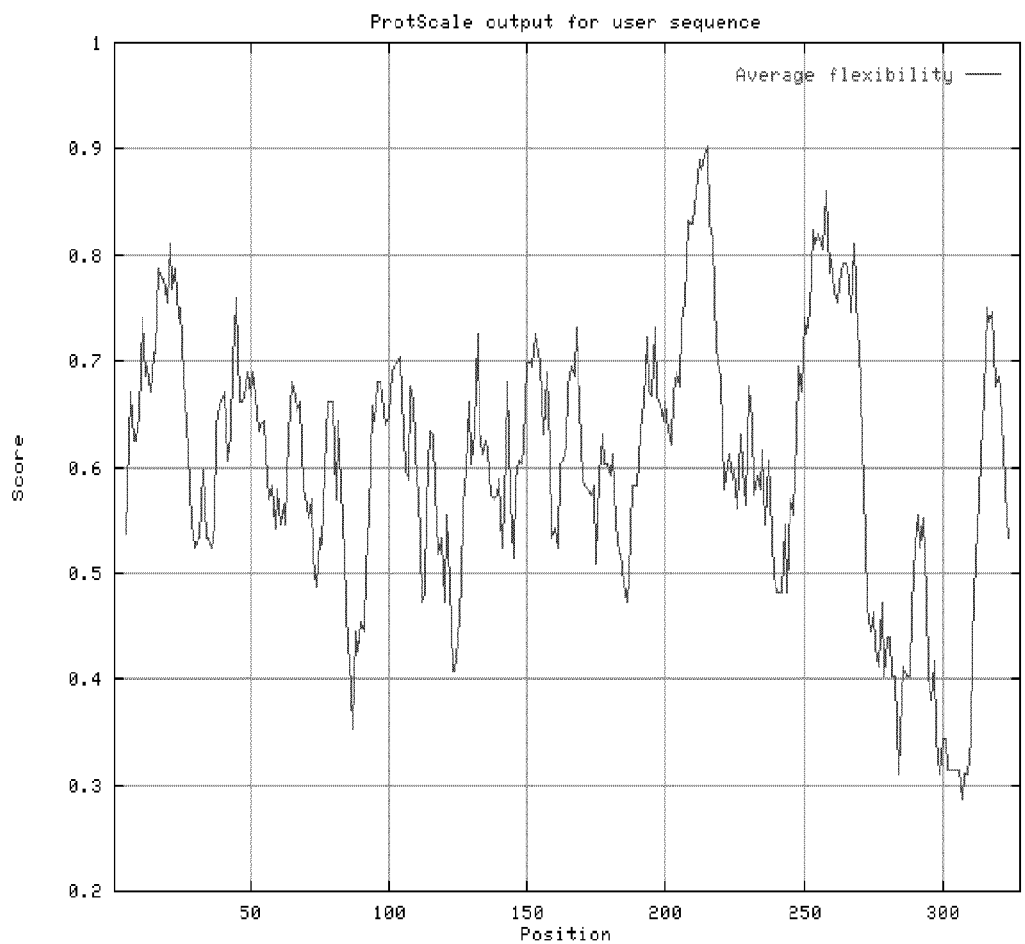

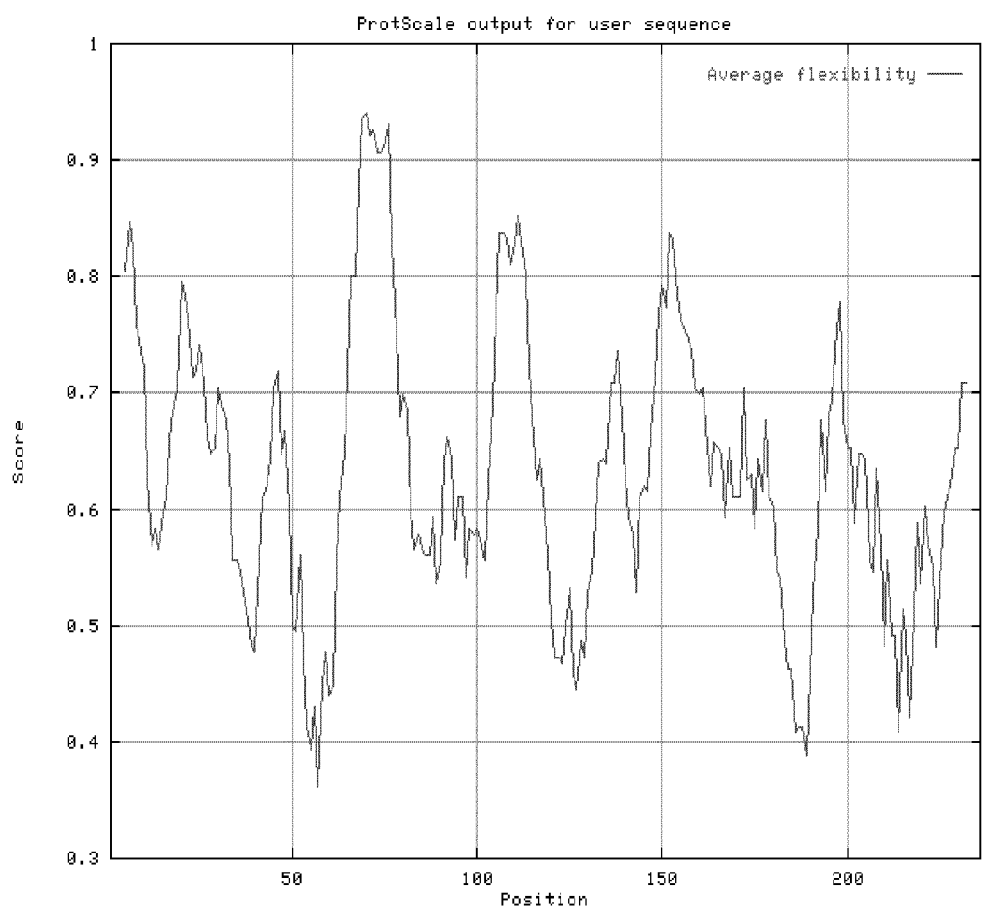
Figure 8b: 158P3D2 variant 2a
Average Flexibility Profile
(Bhaskaran R., Ponnuswamy P.K., 1988.
Int. J. Pept. Protein Res. 32:242-255)

Figure 8c: 158P3D2 variant 2b
Average Flexibility Profile
(Bhaskaran R., Ponnuswamy P.K., 1988.
Int. J. Pept. Protein Res. 32:242-255)
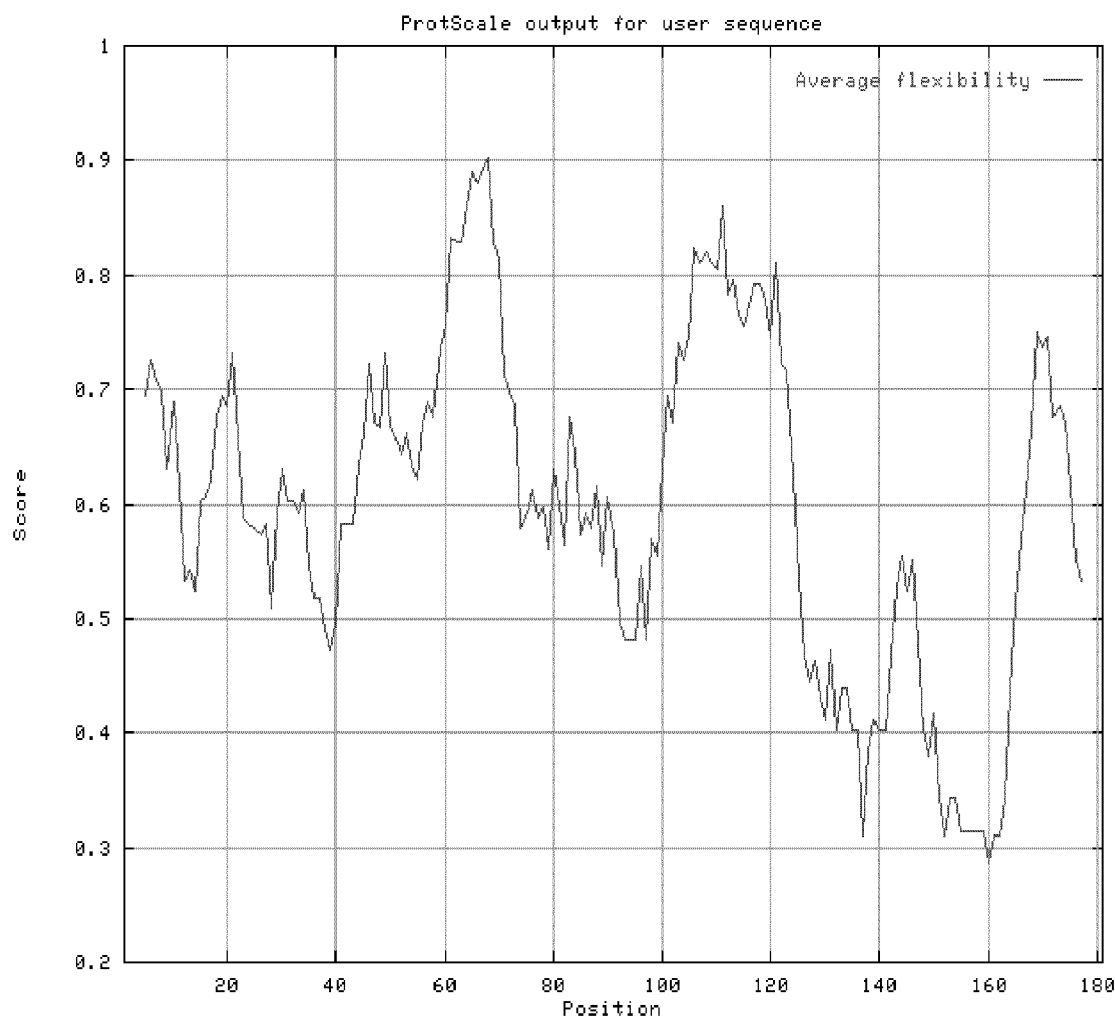

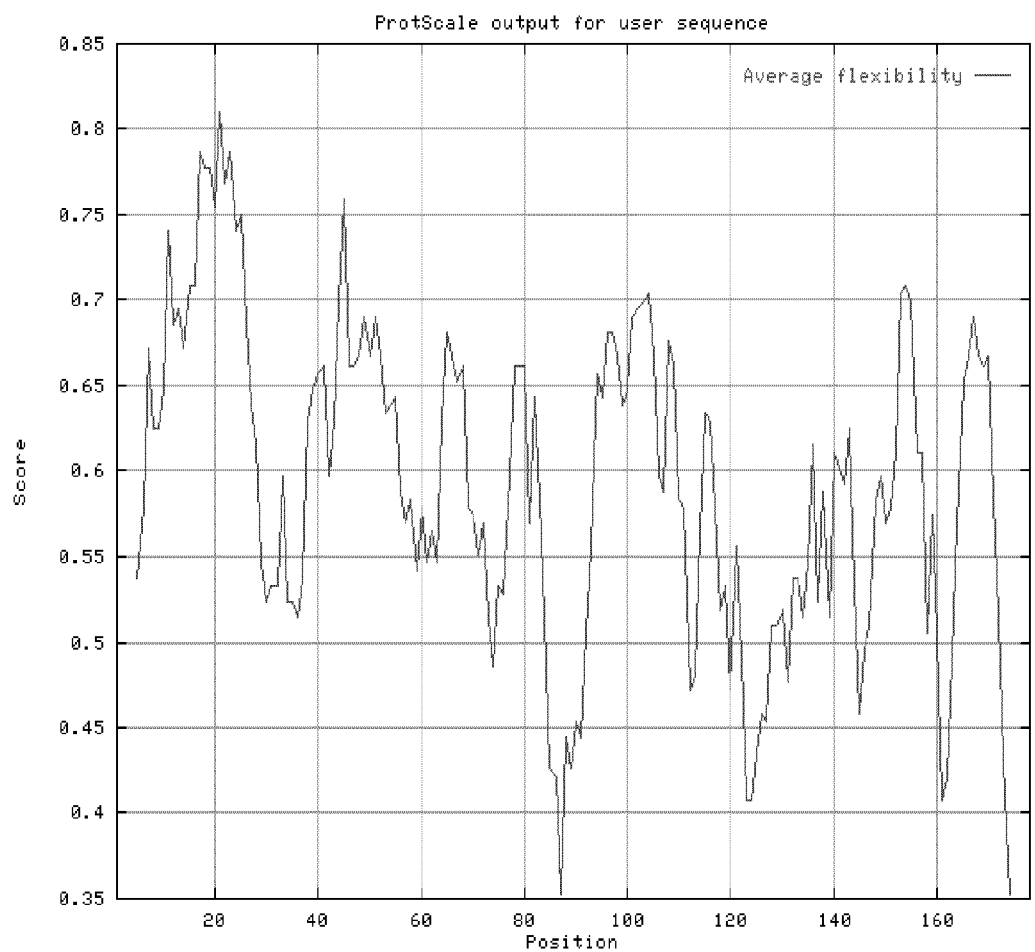
Figure 8d: 158P3D2 variant 5a
Average Flexibility Profile
(Bhaskaran R., Ponnuswamy P.K., 1988.
Int. J. Pept. Protein Res. 32:242-255)

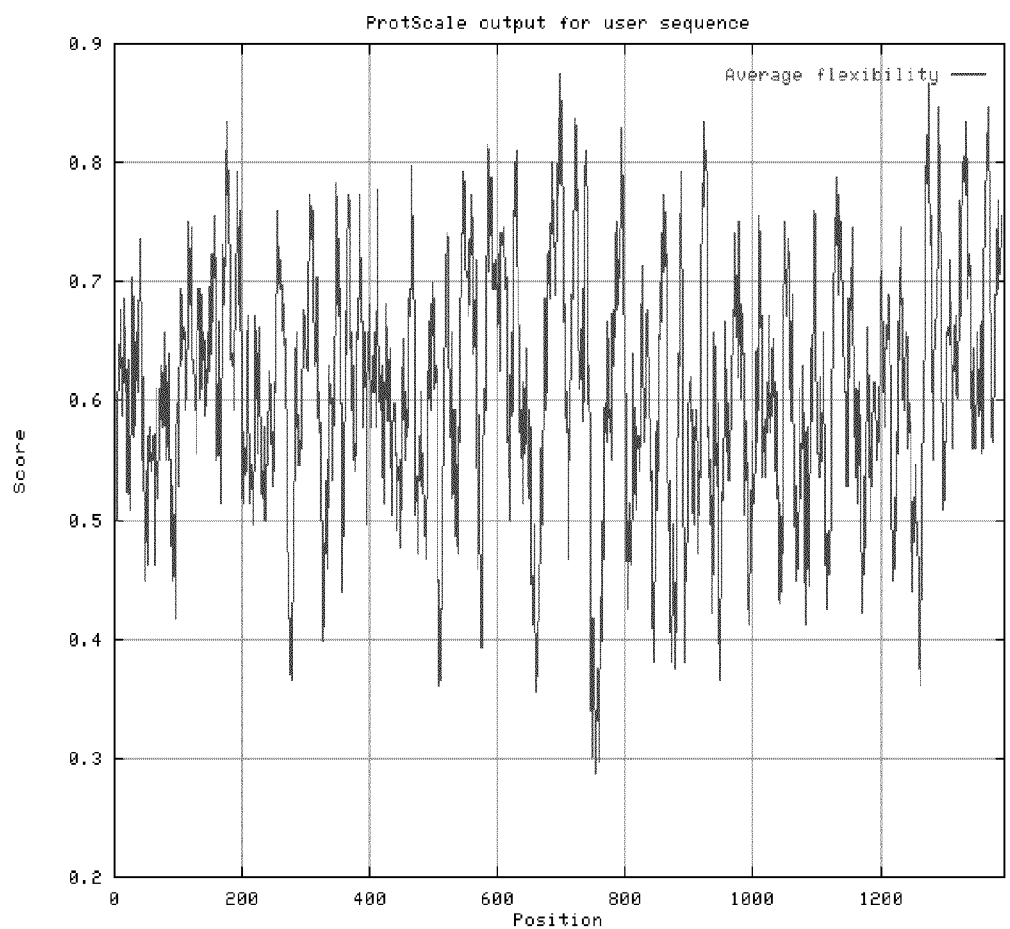
Figure 8e: 158P3D2 variant 14 Average Flexibility Profile
(Bhaskaran R., Ponnuswamy P.K., 1988. Int. J. Pept. Protein Res. 32:242-255)

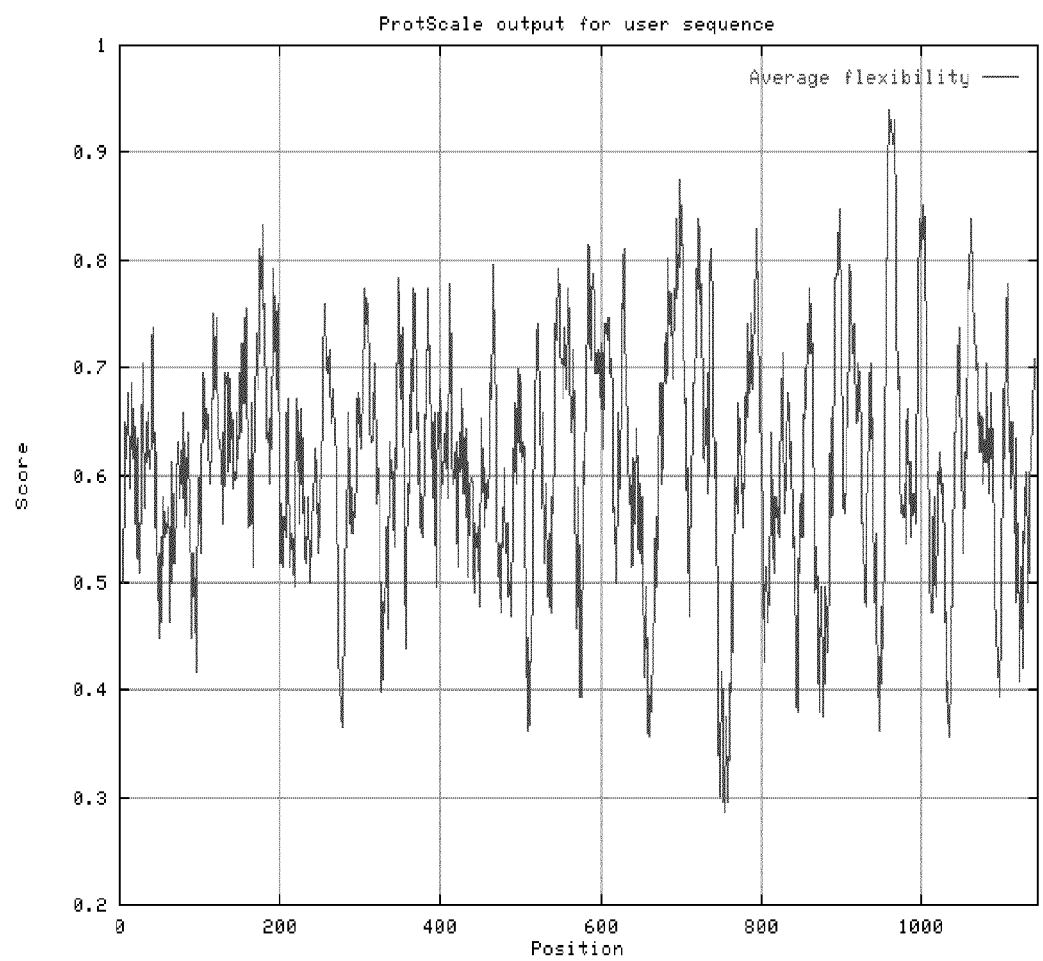
Figure 8f: 158P3D2 variant 15 Average Flexibility Profile
(Bhaskaran R., Ponnuswamy P.K., 1988. Int. J. Pept. Protein Res. 32:242-255)

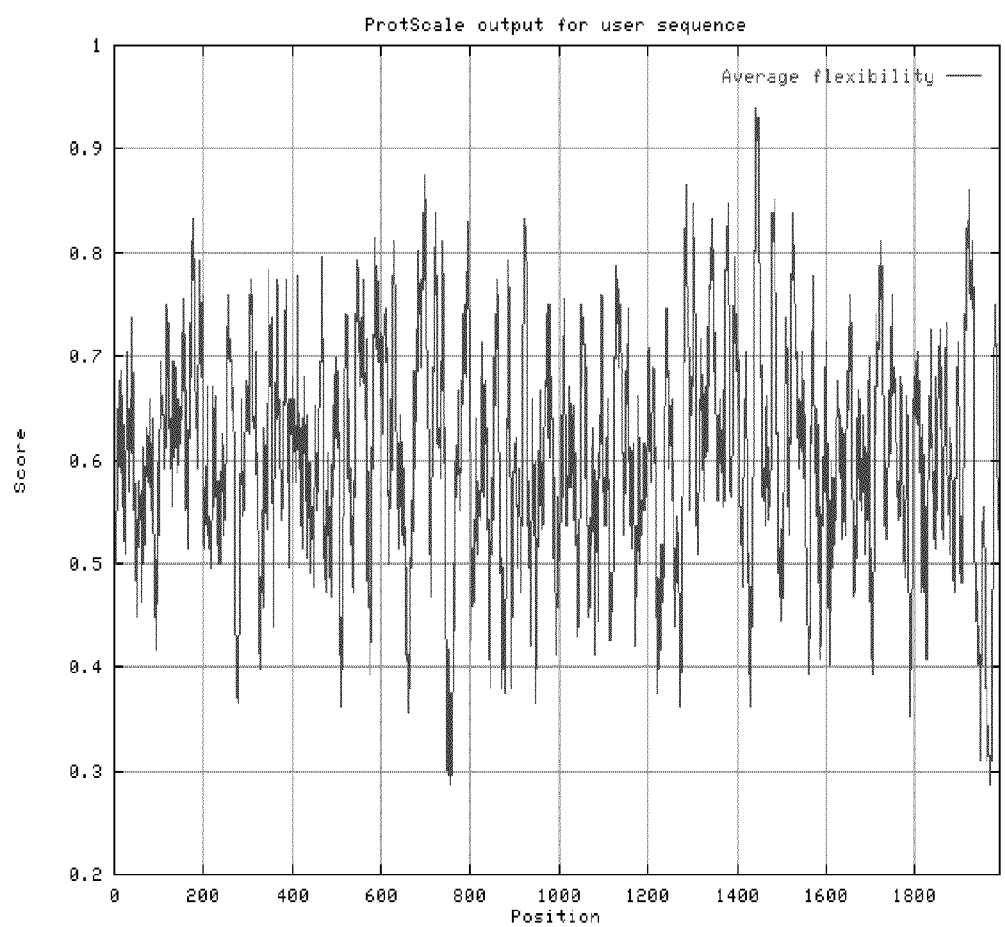
Figure 8g: 158P3D2 variant 16
Average Flexibility Profile
(Bhaskaran R., Ponnuswamy P.K., 1988.
Int. J. Pept. Protein Res. 32:242-255)

Figure 8h:158P3D2 variant 17
Average Flexibility Profile
(Bhaskaran R., Ponnuswamy P.K., 1988.
Int. J. Pept. Protein Res. 32:242-255)
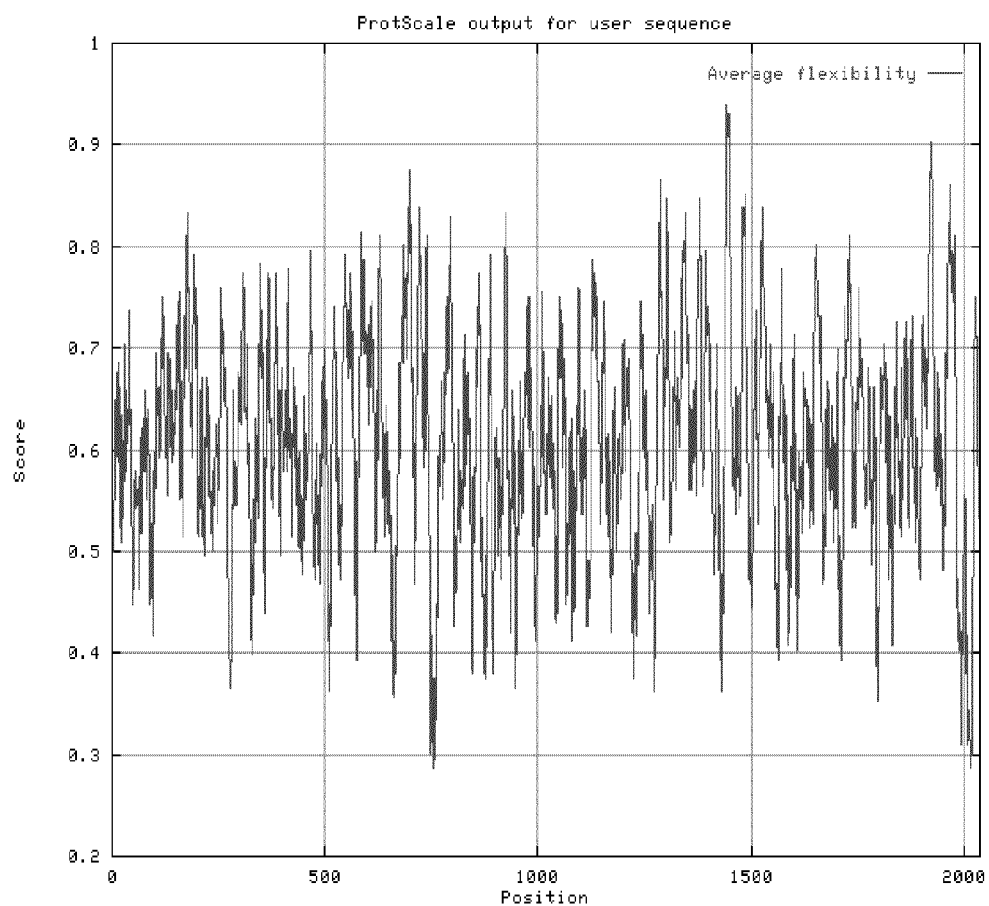

Figure 8i: 158P3D2 variant 18
Average Flexibility Profile
(Bhaskaran R., Ponnuswamy P.K., 1988.
Int. J. Pept. Protein Res. 32:242-255)
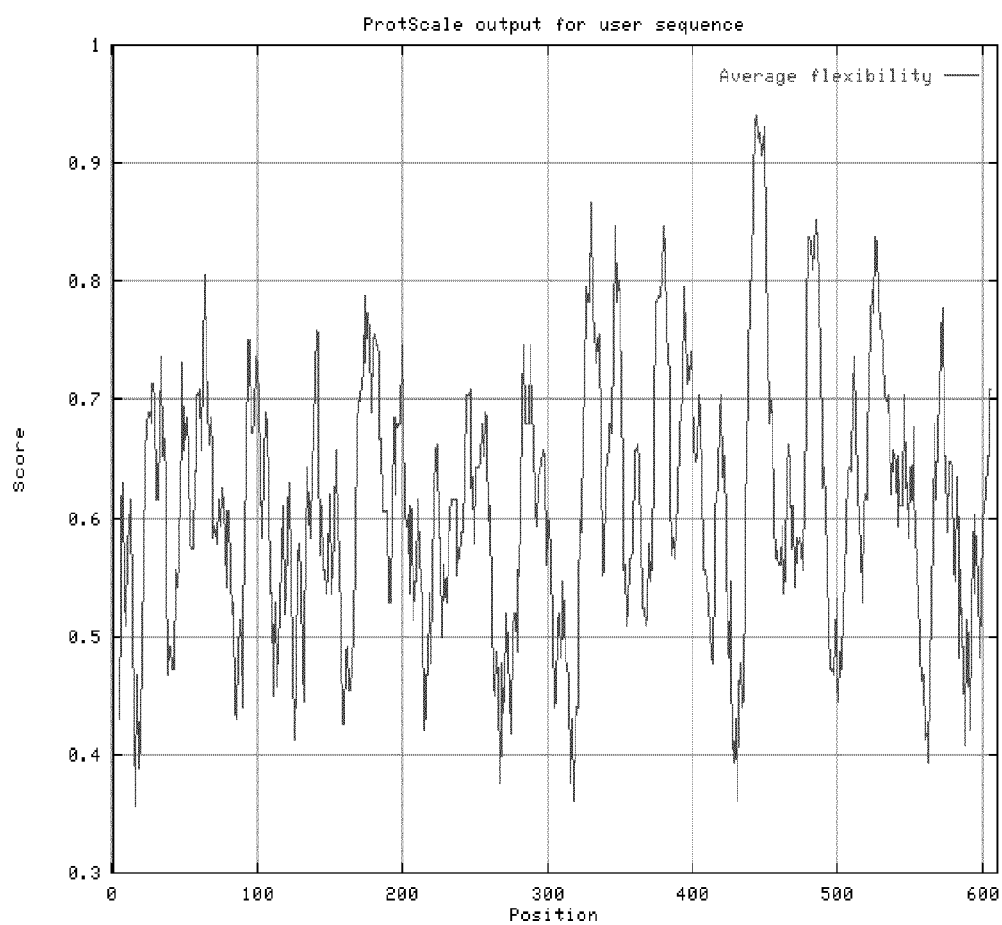

Figure 9a: 158P3D2 variant 1
Beta-turn Profile
(Deleage, G., Roux B. 1987. Protein Engineering 1:289-294)
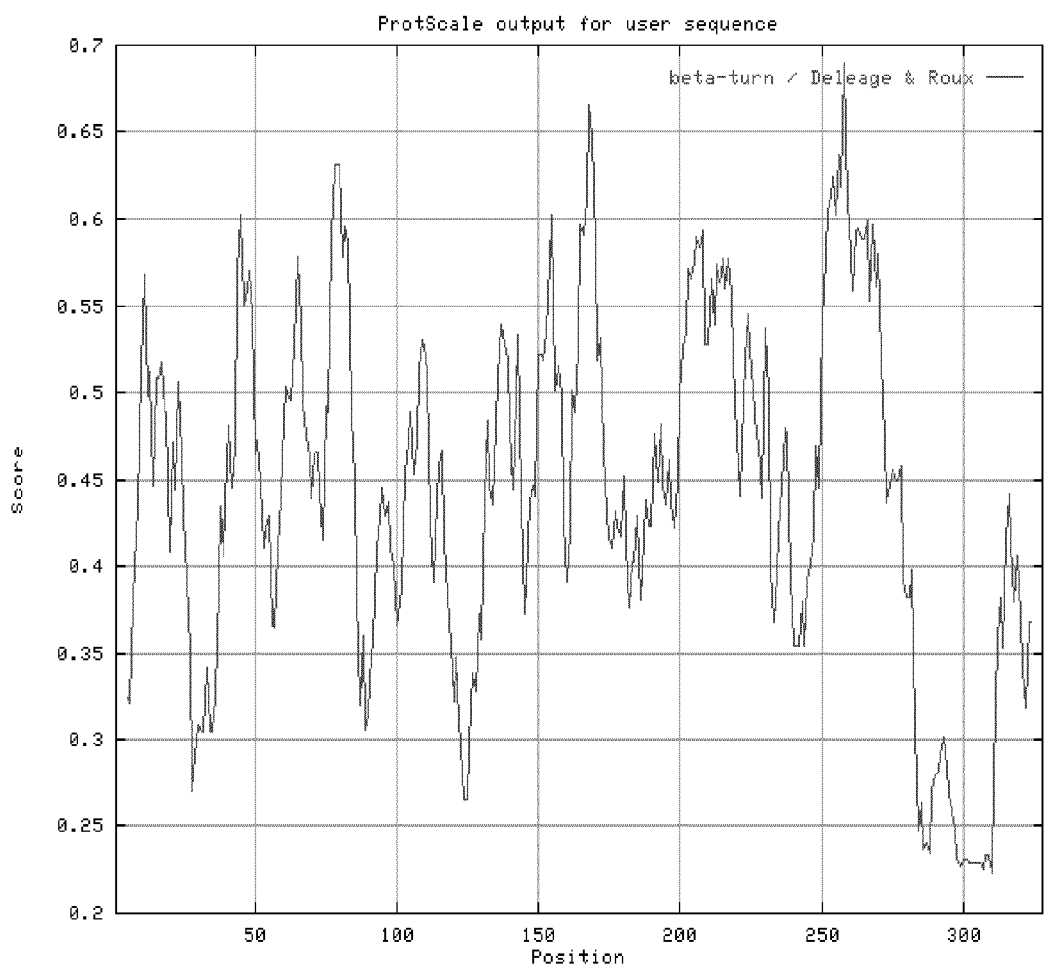

Figure 9b: 158P3D2 variant 2a
Beta-turn Profile
(Deleage, G., Roux B. 1987. Protein Engineering 1:289-294)
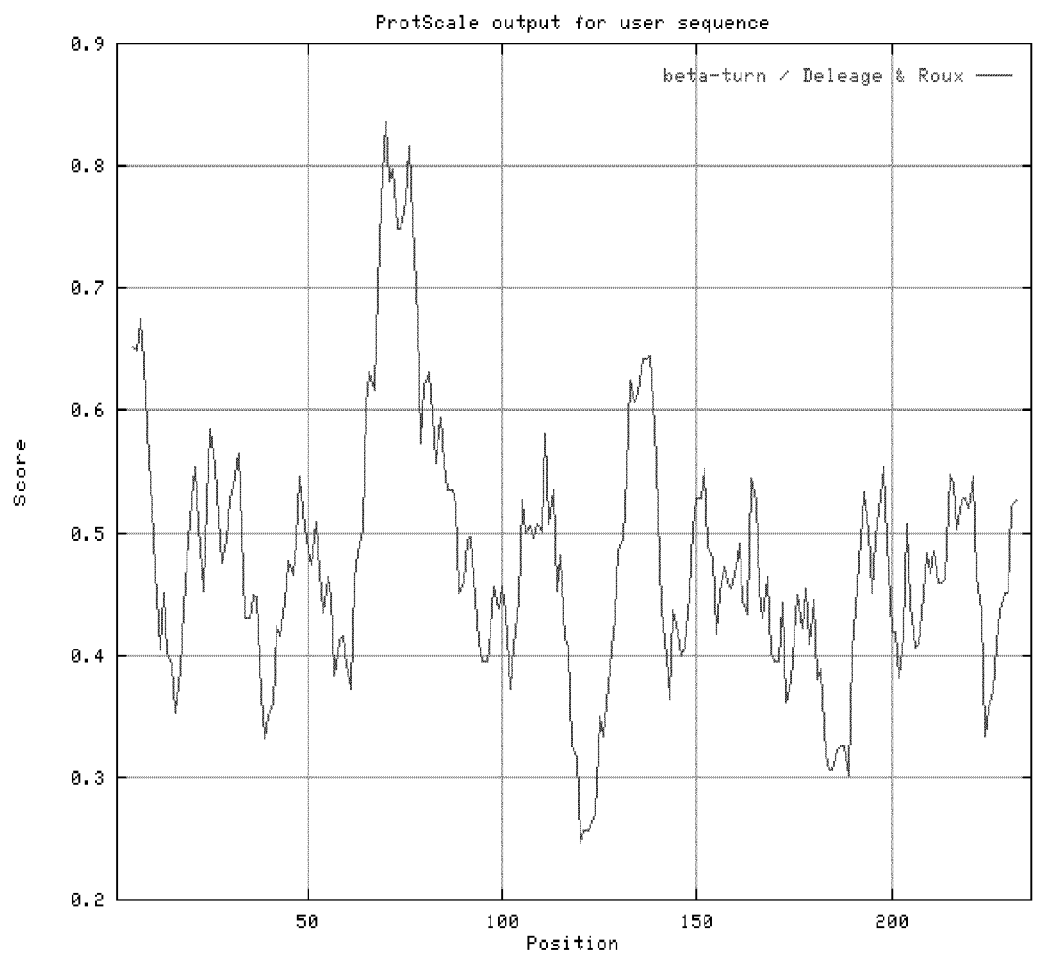

Figure 9c: 158P3D2 variant 2b
Beta-turn Profile
(Deleage, G., Roux B. 1987. Protein Engineering 1:289-294)
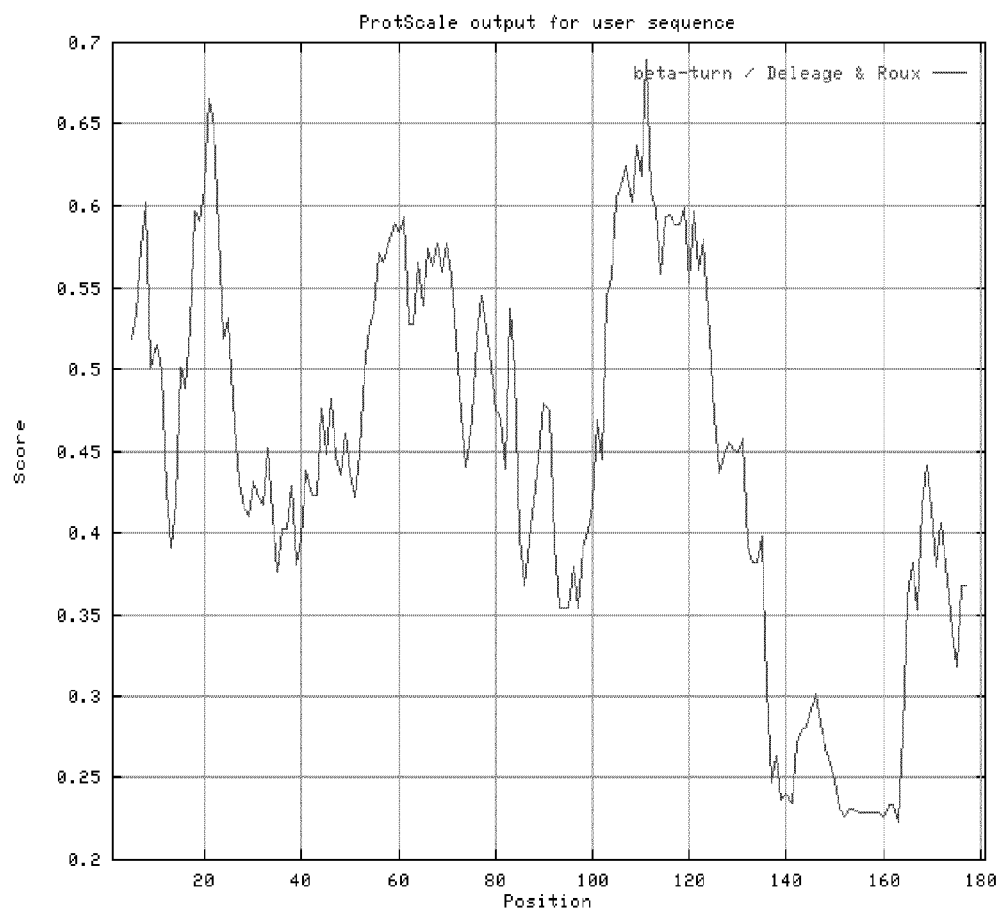

Figure 9d: 158P3D2 variant 5a
Beta-turn Profile
(Deleage, G., Roux B. 1987. Protein Engineering 1:289-294)
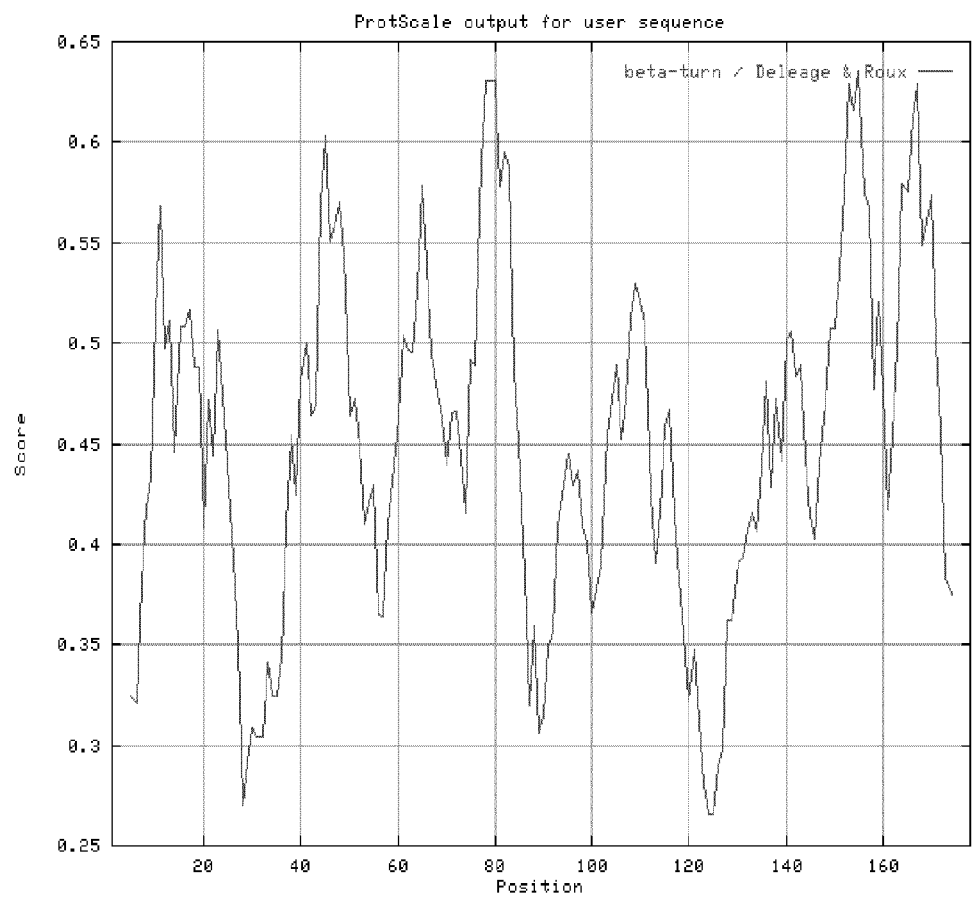

Figure 9e: 158P3D2 variant 14
Beta-turn Profile
(Deleage, G., Roux B. 1987. Protein Engineering 1:289-294)
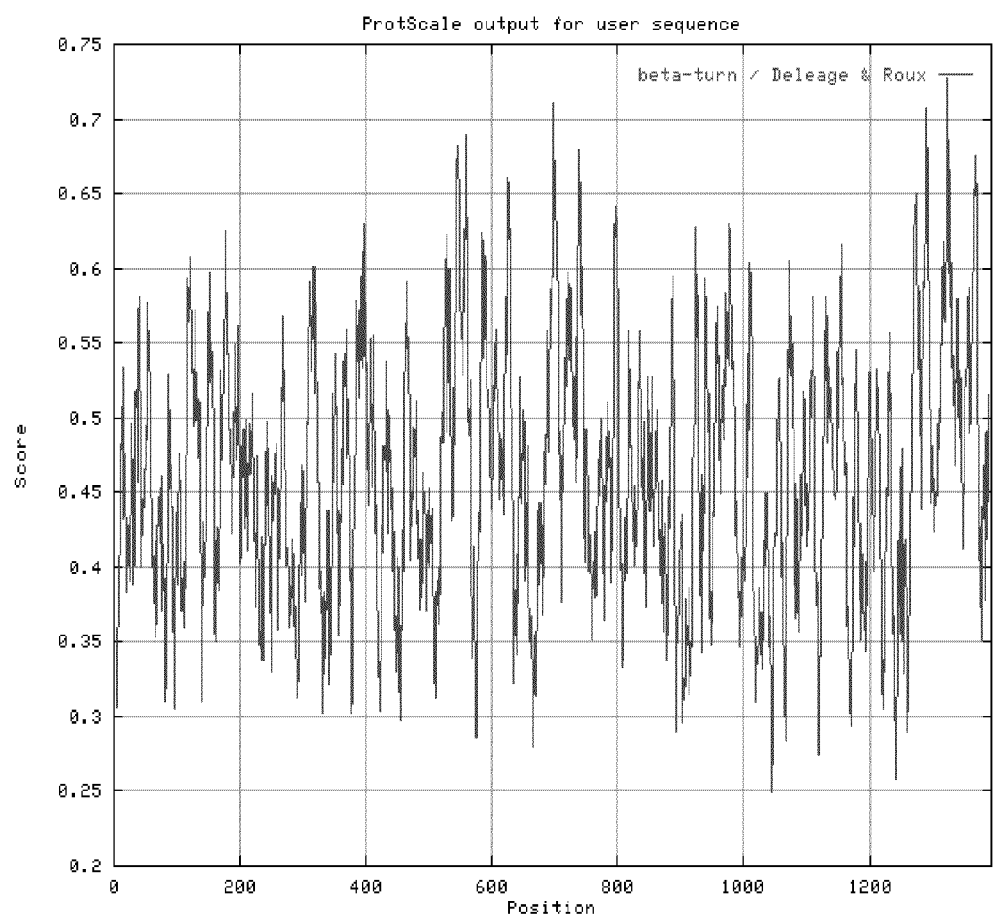

Figure 9f: 158P3D2 variant 15
Beta-turn Profile
(Deleage, G., Roux B. 1987. Protein Engineering 1:289-294)
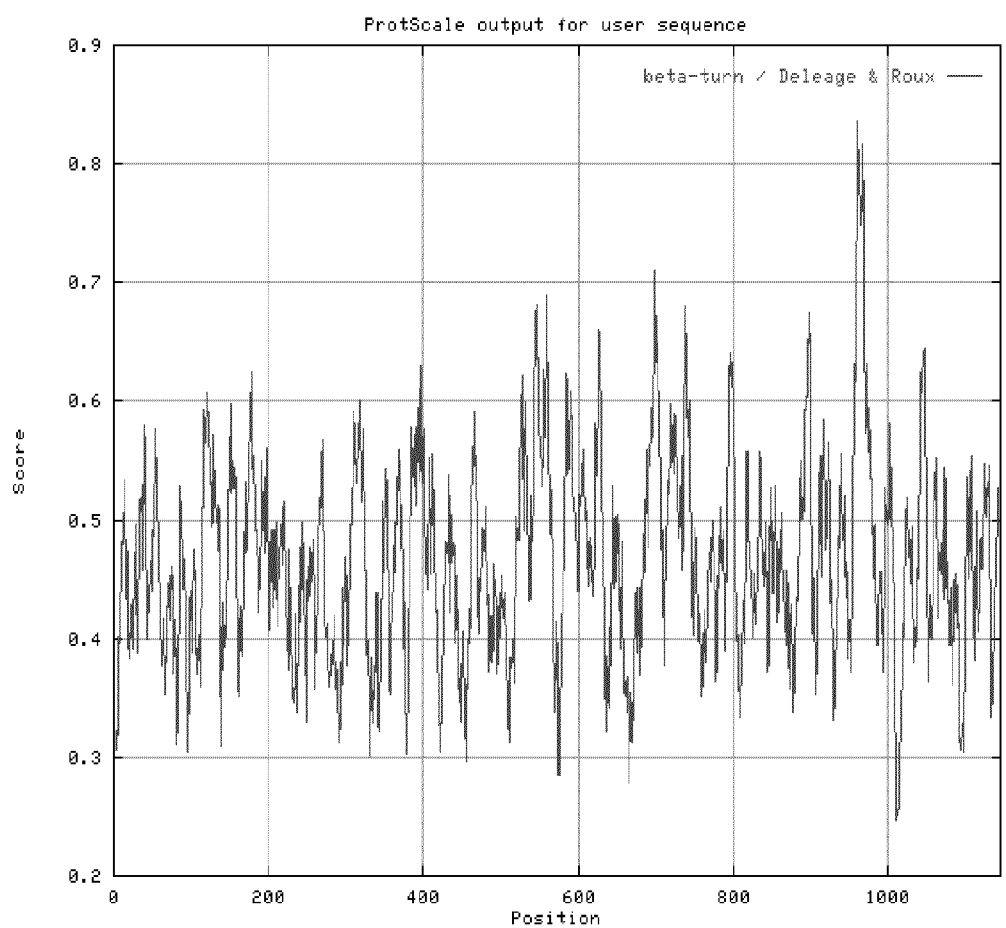

Figure 9g: 158P3D2 variant 16
Beta-turn Profile
(Deleage, G., Roux B. 1987. Protein Engineering 1:289-294)
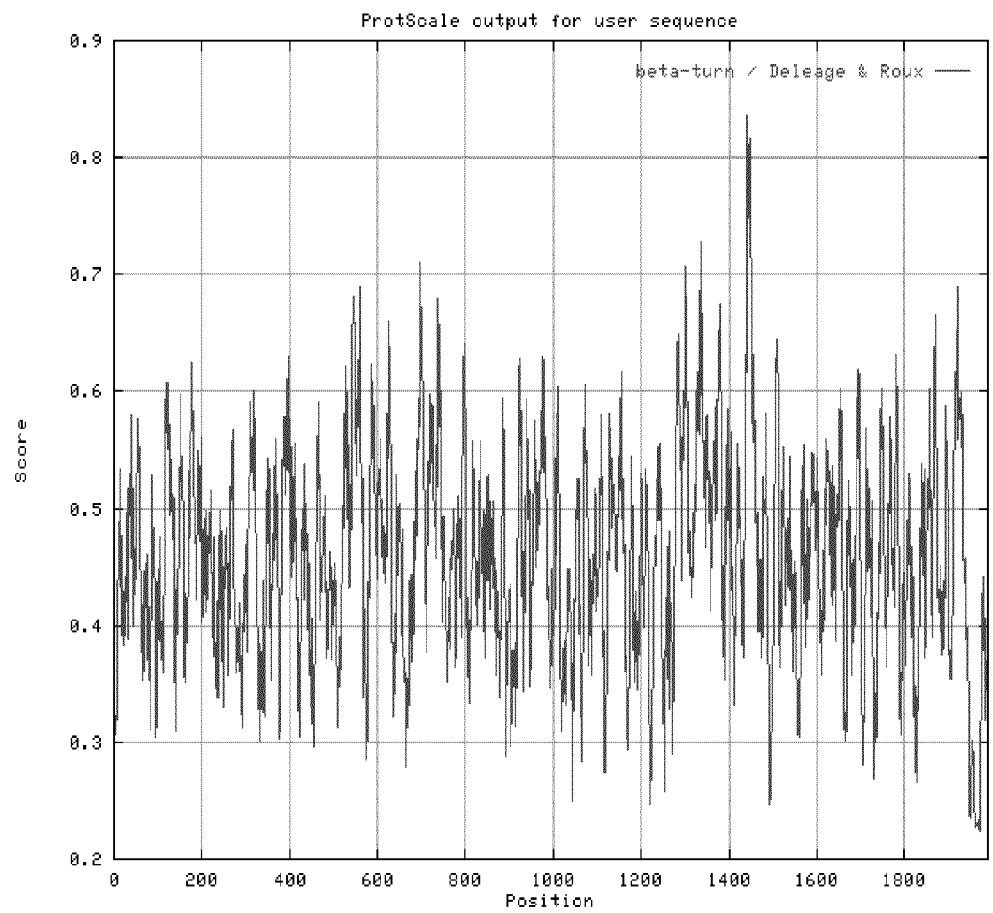

Figure 9h: 158P3D2 variant 17
Beta-turn Profile
(Deleage, G., Roux B. 1987. Protein Engineering 1:289-294)
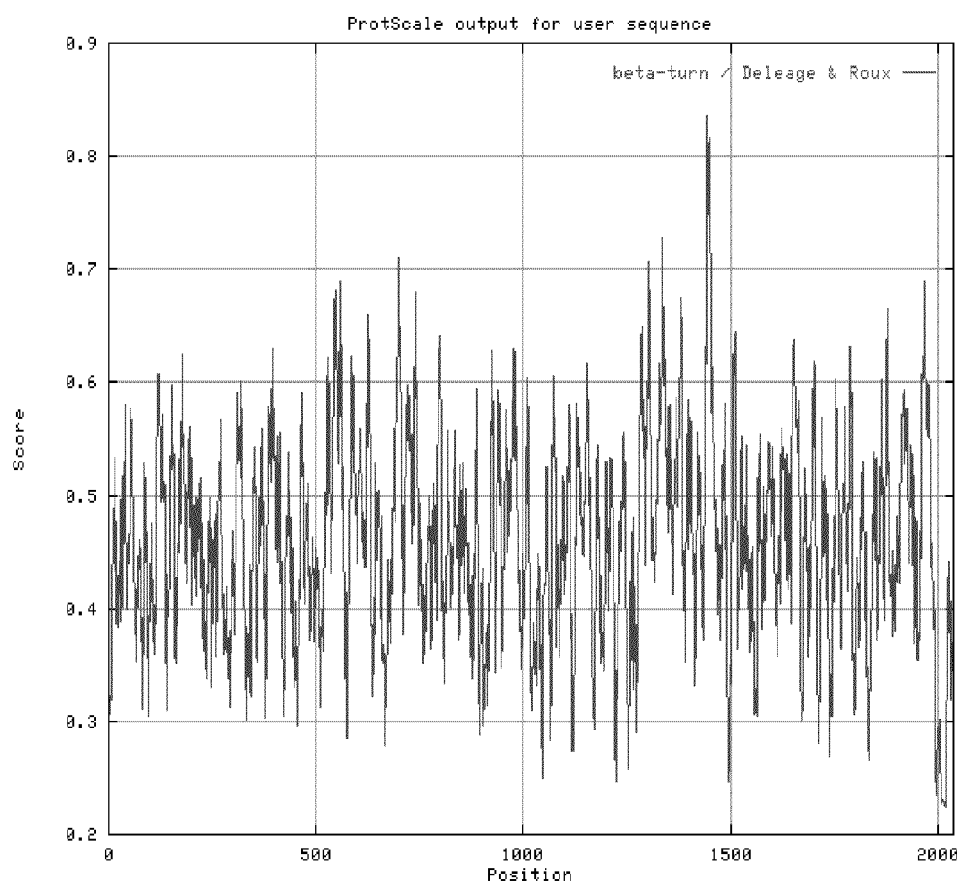

Figure 9i: 158P3D2 variant 18
Beta-turn Profile
(Deleage, G., Roux B. 1987. Protein Engineering 1:289-294)
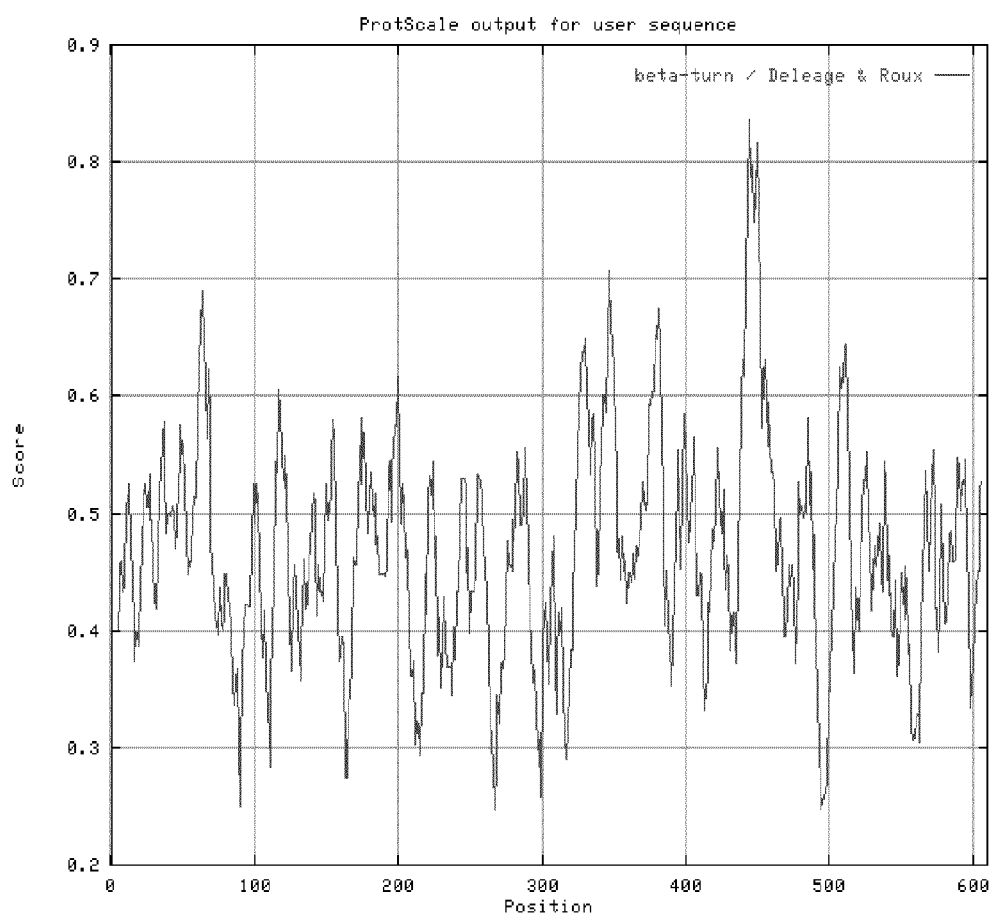

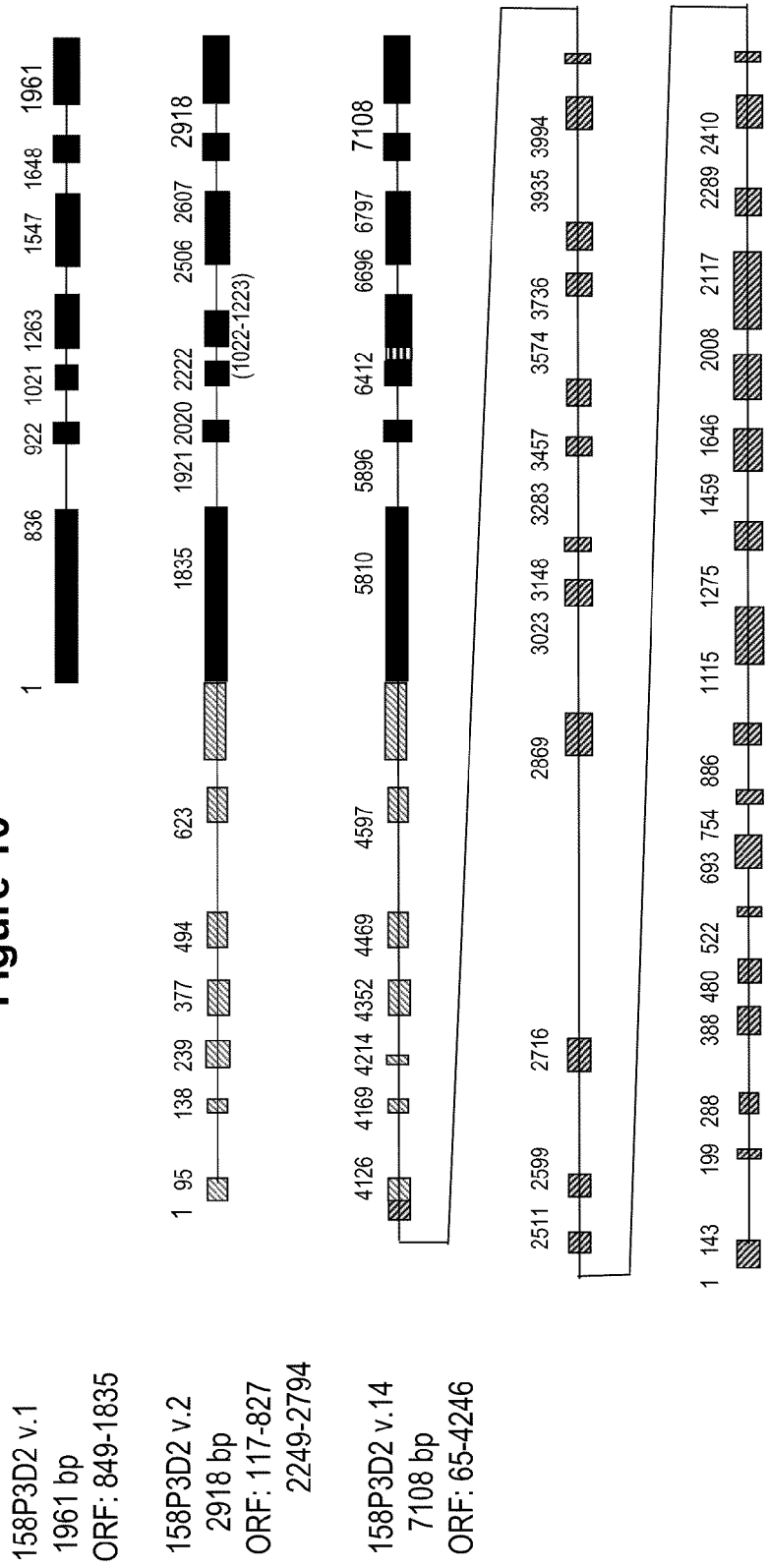

158P3D2 v.2
2918 bp
ORF: 117-827

158P3D2 v.16
6161 bp
ORF: 65-6037

Figure 13A: Secondary structure prediction of 158P3D2 variant 1

```
        10         20         30         40         50         60         70         80         90        100
         |          |          |          |          |          |          |          |          |          |
MWIDIFPQDVPAPPPVDIKPRQPISYELRVVIWNTEDVVLDDENPLTGEMSSDIYVKSWVKGLEHDQETDVHFNSLTGEGNFNWRFVFRFDYLPTEREV
ceeeecccccccccccccccccccccceeeeeeeeccccccccccccccccchhhhhcccccccccccccceeeeeeeeeeeeeecccccccccccee
SVWRRSGPFALEEAEFRQPAVLVLQVWDYDRISANDFLGSLELQLPDMVRGARGPELCSVQLARNGAGPRCNLFRCRRLRGWWPVVKLKEAEDVEREAQE
ehhhccccchhhhhccceeeeeeeecccceeeeeccchhhhhcccccccccccchhhhhcccccccccceeehhhhcccccceeeecchhhhhhhhh
AQAGKKKRKQRRKGRPEDLEFTDMGGNVYILTGKVEAEFELLTVEEAEKRPVGKGRKQPEPLEKPSRPKTSFNWFVNPLKTFVFFIWRRYWRTLVLLLL
hhccchhhhccccccccccccceeeeeeccceeehhhhhhccccccccccccccccccceeecchhhhhhhhhhhhhhhhhhhhhh
VLLTVFLLLVFYTIPGQISQVIFRPLHK
hhhhhhhhhhccchhheeccccc Alpha helix       (h):  32.93%
Extended strand   (e):  18.29%
Random coil       (c):  48.78%
```

Figure 13B: Secondary structure prediction of 158P3D2 variant 2a

```
          10        20        30        40        50        60        70        80        90       100
          |         |         |         |         |         |         |         |         |         |
MDDPGDSDGVNLISMVGEIQDQGEAEVKGTVSPKKAVATLKIKIYNRSLEEEFNHFEDWLNVFPLYRGQGQDGGEEEGSGHLVGKFKGSFLIYPESEAVL
cccccccccceeeeccccccccccccccccccchhhhhhhhhhhchhhhhhhhhhhhhccccccccccccccccccccceeeeeeeccccccccceee
FSEPQISRGIPQNRPIKLLVRVYVVKATNLAPADPNGKADPYVVVSAGRERQDTKERYIPKQLNPIFGEILELSISLPAETELTVAVFEHDLVGSDDLIG
eccccccccccccccccccccccchhhhhhhhhhhccccccccccccccccccceeeeeeccccccccchhhhhhhhheeeecccccccceeeeeeeccccccccchch
ETHIDLENRFYSHHRANCGLASQYEVWVQQGPQEPF
chhhhhhhhhhccccccccccccccceeeeccccccc
```

```
Alpha helix      (h):  25.85%
Extended strand  (e):  18.22%
Random coil      (c):  55.93%
```

Figure 13C: Secondary structure prediction of 158P3D2 variant 2b

```
         10        20        30        40        50        60        70        80        90       100
         |         |         |         |         |         |         |         |         |         |
MVRGARGPELCSVQLARNGAGPRCNLFRCRRLRGWPVVKLKEAEDVEREAQEAQAGKKKRKQRRRKGRPEDLEFTDMGNVYILTGKVEAEFELLTVEE
ccccccccehhhhhhhccccccccccchehhhccccccceeeecchhhhhhhhcccchhhhhhhhcccccccccccceeeccccceeecccceeehhhhhhhh
AEKRPVGKGRKQPEPLEKPSRPKTSFNWFVNPLKTFVFFIWRRYWRTLVLLLVLLLVFYTIPGQISQVIFRPLHK
hhhccccccccccccccccccccccceeccchhhhhhhhhhhhhhhhhhhhhhhhhhccchhheeccccc Alpha helix       (h):  44.75%
Extended strand   (e):  11.60%
Random coil       (c):  43.65%
```

Figure 13D: Secondary structure prediction of 158P3D2 variant 5a

```
         10         20         30         40         50         60         70         80         90        100
          |          |          |          |          |          |          |          |          |          |
MWIDIFPQDVPAPPVDIKPRQPISYELRVVIWNTEDLVLDDENPLTGEMSSDIYVKSWVKGLEHDKQETDVHFNSLTGEGNFNWRFVFRFDYLPTEREV
ceeeeccccccccccccccccccceeeeeeeeeccccccccccccccccchheehhhhhcccccccccceeeeccccccccceeeeeeeeeeeeeee
SVWRRSGPFALEEAEFRQPAVLVLQVWDYTASLPMTSLDPWSCSYQTWCVGPGAPSSALCSWPAMGPGRGAICFAAAA
ehhhccccchhhhhhccccceeeeeeeccccccccccccccccceeccccccccccccccccccccccceeeeeccc Alpha helix      (h):  9.55 %
Extended strand  (e): 26.40 %
Random coil      (c): 64.04 %
```

Figure 13E: Secondary structure prediction of 158P3D2 variant 14

```
         10         20         30         40         50         60         70         80         90        100
          |          |          |          |          |          |          |          |          |          |
MALTVSVQRLTGLTGTHDRQVKLTFRGFTQKTRKIHCGPEADIGELFRWPHYGAPLAGECLSVQVVNCSRVFSLRPLGTLVISLQQLQNAGHLVLREALV
ceeeeeeecccccchheeehecccchchheecccccccccchhhheccccccccccchheeeeeecccchhhehhhhhhhchhhhhhhhh DENLQVSPIQVELDLKYQPPEGATGAWSEEDFGAPIQDSFELIIPNVGFQELEPGEAQLERRAVALGRRLARSLGQQDDEENELELELEQDLDDEPDVEL
cccccccceeeeecccccccccccccccccccccchheeccccccccccchhhhhccccccccccchhhhhhhhhcccccccccc SGVMFSPLKSRARALAHGDPFQVSRAQDFQVGVTVLEAQKLVGVNINPYVAVQVGGQRRVTATQRGTSCPFYNEVFLFEFHDTRLRLQDLLLEITVSGVG
cchhhhhhhhhhccccccceecccccccccceehthhhhhecccceeeeeeccccccccccccccheeehccchhhhheeeeecccc VTSVLQRRGDEKAAGLTPPSPKAFHSQTLPFMATRIGTFRMDLGIILDQPDGQFYQRWPLHDPRDTRAGTKGF-KVTLSVRARGDLPPPMLPPAPGHCS
eeeeecccccccccceeeecccccccccchhhhccccceeeeecccccccccccccceeeeeeeeccccceeeeeeeeccccccccccccccccc DIEKNLLLPRGVPAERPWARLRVRLYRAEGLPALRLGLLGSLVRALHDQRVLVEPYVRVSFLGQEETSVSAEAAAPEWNEQLSFVELFPPLTRSLRLQL
ccccceeccccchhhhhhhhhhhcccchhhhhhhhhhcccceeeecceeeecccccccccccchhhheehhhchhhhhhhhc RDDAPLVDAALATHVPDLRRISHPGRAAGFNPTFGPAWVPLYGSPPGAGLRDSLQGLNEGVGQIWFRGRLLLAVSMQVLEGRAEPEPPQAQQGSTLSRL
ccccchhhhhhhcccchheccccccccccccccccccccccchhhhhhhhhcccheeehhhhhhhhccccccccccchhhhhh TRKKKKARRDQTPKAVPQHLDASPGAEGPEIPRAMEVEVEELLPLPENVLAPCEDFLLFGVLFEATMIDPTVASQPISFEISIGRAGRLEEQLGRGSRA
hrhhhhhhhcccccccccccccccccccccccccccccchhhhhhhhhcccccccccccccchhhheheeeeehecccccccceeeecccccchhhhcccccc GEGTEGAAVEAQPLLGARPEEEKEEEELGTHAQRPEPMDGSGPYFCLPLCHCKPCMHVWSCWEDHTWRLQSSNCVRKVAERLDQGLQEVERLQRKPGPGA
ccccccheccccccccccccchhhccccccccccccccccccccccccccccccchhhhhhhhhhchhhhhhhhhcccccccc Alpha helix       (h): 33.88 %
Extended strand   (e): 13.42 %
Random coil       (c): 52.69 %
```

Figure 13E-2: Secondary structure prediction of 158P3D2 variant 14

```
         810       820       830       840       850       860       870       880       890       900
          |         |         |         |         |         |         |         |         |         |
CAQLKQALEVLVAGSRQFCHGAERRTMTRPNALDRCRGKLLVHSLNLLAKQGLRLLRGLRRRNVQKKVALAKKLLAKLRFLAEEPQPPLPDVLVWMLSGQ
hhhhhhhhhhhhhcccheccccccccchhcccchhhhhhhhhhhhhhhhhhhhhhhhhhhhhhhhhhhhhhhhhhhhhhhhcccccchhheehchc RRVAWARIPAQDVLFSVVEEERGRDCGKIQSLMLTAPGAAPGEVCAKLELFLRLGLGKQAKACTSELPPDLLPEPSAGLPSSLHRDDFSYFQLRAHLYQA
hhhhhccchheeheeccccccccceeeeccccccccchhhhhhhhhhhccccchhhhhhhhhhhhhhhhhccccchhcccccccccchchhhhhhhhhc RGVLAADDSGLSDPFARVLISTQCQTTRVLEQTLSPLWDELLVFEQLIVDGRREHLQEEPPLVIINVFDHNKFGPPVFLGRALAAPRVKLMEDPYQRPEL
cceeeccccccccchhhhhehccccchhhhhhhhhhhhhhhhhhhhhhhccchhcccccccceeeehccchhccceeecccccccc QFFPLRKGPWAAGELIAAFQLIELDYSGRLEPSVPSEVEPQDLAPIVEPHSGRLSLPPNVCPVLREFRVEVLFWGLRGLGRVHLLEVEQPQVVLEVAGQG
cccccccccchhhhhhhhhhhhhhhhhhhccccccccccccccccchhhhhhhhhhhhhhhccccheeeeeecccceeeeeeeccccc VESEVLASYRESPNFTELVRHLTVDLPEQPYLQPPLSIIVIERRAFGHTVLVGSHIVPHMLRFTFFRGHEDPPEEEGEMEETGDMPKGPQGQKSLDPFLA
chheehhhccccchhhheeeccccccccccccchheeehhhhhccccccccccchhhhheheeeccccccccccccccccccchhhhh EAGISRQLLKPPLKKLPLGGLLNQGPGLEEDIPDPEELDWGSKYYASLQELQGQHNFDEDEMDDPGDSGVNLISMVGEIQDQDLQQVPEGRI
hcchhhhhccccccccccccccccccceeeccccccccc
```

Figure 13F: Secondary structure prediction of 158P3D2 variant 15

```
        10         20         30         40         50         60         70         80         90        100
         |          |          |          |          |          |          |          |          |          |
MALTVSVQRLTGLTGTHDRQVKLTFRGFTQKTRKIHCGPEADIGELFRWPHYGAPLAGECLSVQVVNCSRVFSLRPLGTLVISLQQLQNAGHLVLREALV
ceeeeeeeecccccchheeheccchhheecccccchhheeccccccchhhhheccccccchhheeeeeccceeeecccchhhehhhhhchhhhhhhhh DENLQVSPIQVELDLKYQPPEGATGAWSEEDFGAPIQDSFELIIPNVGFQELEPGEAQLERRAVALGRRLARSLGQQDDEENELELELEQDLDDEPDVEL
ccccccceeeecccccccccccccccccccccccchheeecccccccchhhhhhhhhhhhhcccccchhhhhhhhhhhhhhhhhhhccccccccc SGVMFSPLKSRARALAHGDPFQVSRAQDFQVGVTVLEAQKLVGVNINPYVAVQVGGQRRVTATQRGTSCPFYNEYFLFEFHDTRLRLQDLLLEITVSGVG
cchhhhhhhhhhhhccccccceecccccccccchhhhhhhhheccccceeeeeeccccccccccheeehccccchhhhhheeeecccc VTSVLQRRGDEKAAGLTPPSPKAFHSQTLPFMATRIGTFRMDLGIILDQPDGQFYQRWVPLHDPRDTRAGTKGFIKVTLSVRARGDLPPPMLPPAPGHCS
eeeeeecccccccccccccccccccccchhhhhcccceeeeeeccccccccccceeeeeccccccccceeeeeccccccccccccccccccc DIFKNLLLPRGVPAERPWARLRVRLYRAEGLPALRLGLLGSIVRALHDQRVLVEPYVRVSFLGQEGETSVSAEAAAPWNEQLSFVELFPPLTRSLRLQL
cccccccccccccccccchhhhhhhhhhhhcccchhhhhhhhhhcccceeeeeccccccceeeeeeccccccchhheehhhchhhhhhhc RDDAPLVDAALATHVPDLRRISHPGRAAGFNPTFGPAWVPLYGSPPGAGLRDSLQGLNEGVGQGIWFRGRLLLAVSMQVLEGRAEPEPPQAQQGSTLSRL
cccccchhhhhhhhcccchheccccccccccccccccccccccccccccchhhhhhhhhhhhhcccheeehhhhhhhhhhhhcccccccchhhhhh TRKKKKKARRDQTPKAVPQHLDASPGAEGPEIPRAMEVEVEELLPIPENVIAPCEDFLLFGVLFEATMIDPTVASQPISFEISIGRAGRLEEQLGRGSRA
Hhhhhhhcccccccccccccccccccccccccccchhhhhhhheheeeeehcccccccccceeeeeccccchhhhcccccc GEGTEGAAVEAQPLLGARPEEKEEELGTHAQRPEPMDGSGPYFCLPLCHCKPCMHVWSCWEDHTWRLQSSNCVRKVAERLDQGLQEVERLQRKPGPGA
cccccccheccchhhhhcccccccccccccccccccccccccccccccccccccccccchhhhhhhhhhhchhhhhhhhcccccc
```

```
Alpha helix        (h):  33.28 %
Extended strand    (e):  15.11 %
Random coil        (c):  51.62 %
```

Figure 13F-2: Secondary structure prediction of 158P3D2 variant 15

```
         810        820        830        840        850        860        870        880        890        900
          |          |          |          |          |          |          |          |          |          |
CAQLKQALEVLVAGSRQFCHGAERRTMTRPNALDRCRGKLLVHSLNLLAKQGLRLLRGLRRRNVQKKVALAKKLLAKLRFLAEEHNFDEDEMDDPGDSDG
hhhhhhhhhhhhccchecccccccccccccccchhhccccchhhhhhhhhhhhhhhhhhhhhhhhhhhhhhhhhhhhhhhhhhhhhhhhhccccccccccccc
VNLISMVGEIQDQGEAVKGTVSPKKAVATLKIYNRSLKEEFNHFEDWLNVFPLYRGQGQDGGEEGSHLVGKFKGSFLIYPESEAVLFSEPQISRG
ceeeeeeccccccccccccccchhhhhhhhhhhhhhhhhhhhhhhhhhhhhhhhhhhhhhhhccccccccccccceeeeecccccccccccccccc
IPQNRPIKLLVRVYVVKLRNLCKIQGHEDFCLFSAATNLAPADPNGKADPYVVVSAGRERQDTKERYIPKQLNPIFGEILELSISLPAETELTVAVFDHD
cccchhhhhhhhhhhhhhhhhhhhhhccccceeeeeccccccccccccccccccchhccccchhhhhhhhhheeeecccccceeeeeeeccc
LVGSDDLIGETHIDLENRFYSHHRANCGLASQYEVWVQQGPQEPF
cccccchchchhhhhhhhhccccccccccceeeeeccccccccc
```

Figure 13G: Secondary structure prediction of 158P3D2 variant 16

```
         10         20         30         40         50         60         70         80         90        100
          |          |          |          |          |          |          |          |          |          |
MALTVSVQRLTGLTGTHDRQVKLTFRGFTQKTRKIHCGPEADIGELFRWPHYGAPLAGECLSVQVVNCSRVFSLRPLGTLVISLQQLQNAGHLVLREALV
ceeeeeeeeecccccchheeheccchchheeccchchheeccchheeccccccccccchhhhecccchhhehhhhhchhhhhhhhh
DENLQVSPIQVELDLKYQPPEGATGAWSEEDFGAPIQDSFELIIPNVGFQELEPGEAQLERRAVALGRRLARSLGQQDDEENELELELEQDLDDEPDVEL
ccccccccceeeecccccccccccccccccccccchheeeccccccccchhhhcccccchhhhhhhhhhhhccccccchhhhhhhhhcccccccccc
SGVMFSPLKSRARALAHGDPFQVSRAQDFQVGVTVLEAQKLVGVNINPYVAVQVGGQRRVTATQRGTSCPFYNEYFLFEFHDTRLRLQDLLIEITVSGVG
cchhhhhhhhhcccccccccccccccccccccchhhhhhhhheccccceeeeecccccccccccccheeehhcccchhhhheeeecccc
VTSVLQRRGDEKAAGLTPPSPKAFHSQTLPFMATRIGTFRMDLGIILDQPDGQFYQRWVPLHDPRDTRAGTKGFIKVTLSVRARGDLPPMLPPAPGHCS
eeeeeeccccccccccccccccccccccccchhhccceeeecccccccccccceeeeccccccccceeeeeeeeccccccccccccc
DIEKNLLLPRGVPAERPWARLRVRLYRAEGLPALRLGLLGSIVRALHDQRVLVEPYVRVSFLGQEGETSVSAEAAAPEWNEQLSFVELFPPLTRSLRLQL
cccccccccccccchhhhhhhhhhhccchhhhhhhhhhhhccccceeeccceeccccchhheehhhchhhhhhhhhc
RDDAPLVDAALATHVPDLRRISHPGRAAGFNPTFGPAWVPLYGSPPGAGLRDSLQGLNEGVGQGIWFRGRLLLAVSMQVLEGRAEPEPPQAQQGSTLSRL
cccchhhhhhhhhhcchhheccccccccccccccccchhhhhhhhhhhcchheeehhhhhcccccccccccchhhhh
TRKKKKARRDQTPKAVPQHLDASPGAEGPEIPRAMEVEVEELLPLPENVLAPCEDFLLFGVLFEATMIDPTVASQPISFEISIGRAGRLEEQLGRGSRA
hhhthhhhccccccccccccccccccccccccccccchcchhheeeeeheccccccccceeeeccccchhhhccccc
GEGTEGAAVEAQPLLGARPEEKEEEELGTHAQRPEPMDGSGPYFCL2LCHCKPCMFVWSCWEDHTWRLQSSNCVRKVAERLDQGLQEVERLQRKPGPGA
cccccchecccccccccccchhhhcccccccccccccccccccccccchhhhhhhhhhhhhhhhhhchhhhhhhcccccc
CAQLKQALEVLVAGSRQFCHGAERRTMTRPNALDRCRGKLLVHSLNLLAKQGLRLRGLRRRNVQKKVALAKKLLAKLRFLAEEPQPPLPDVLVWMLSGQ
hhhhhhhhhhhhcccchhcccchhhhhhhhhhhhhhhhhhhhhhhhhhhhhhhhhhhhhhhhhhhccccccchhhhhheehchc
RRVAWARIPAQDVLFSVVEEERGRDCGKIQSIMLTAPGAAPGEVCAKLELFLRLGLGKQAKACTSELPPDLLPEPSAGLPSSLHRDDFSYFQLRAHLYQA
hhhhhhhccchhheeheeeccccccccceeeeeecccccccccccchhccccccccccchhcccccccchhhhhhhhhhc
```

```
Alpha helix       (h):   32.76 %
Extended strand   (e):   14.47%
Random coil       (c):   52.76%
```

Figure 13G-2: Secondary structure prediction of 158P3D2 variant 16

```
        1010       1020       1030       1040       1050       1060       1070       1080       1090       1100
          |          |          |          |          |          |          |          |          |          |
RGVLAADDSGLSDPFARVLISTQCQTTRVLEQTLSPLWDELLVFEQLIVDGRREHLQEEPPLVIINVFDHNKFGPPVFLGRALAAPRVKLMEDPYQRPEL
cceeecccchhhhhhehcccccchhhhhhhhhhhhhhhhhhhhhhhhhhhcchhccccccceeeecccccccchhcchhccccceeccccccccc
QFFPLRKGPWAAGELIAAFQLIELDYSGRLEPSVPSEVEPQDLAPLVEPHSGRLSLPPNVCPVLREFRVEVLFWGLRGLGRVHLLEVEQPQVVLEVAGQG
ccccccchhhhhhhhhhhhhhhhhhhcccccccccccccccccccccccchhhhhhhhhhhhcccceeeecccceeeeeccc
VESEVLASYRESPNFTELVRHLTVVFKDTAPLFHPQDLPEQPYLQPPLSILVIERRAFGHTVLVGSHIVPHMLRFTFRGHEDPPEEEGEMEETGDMPKG
cheeehhccccccchhehheeeeccccccccccccccccccccccccccccceehhhhcceeeecccchhhhheheeeccccccccccccccccccc
PQGQKSLDPFLAEAGISRQLLKPPLKKLPLGGLLNQPGLEEDIPDPEELDWGSKYYASLQELQQHNFDEDEMDDPGDSDGVNLISMVGEIQDQGEAEV
cccccchhhhhhhcchhhhhhhccccccccccccccccccccccccccccccccccccccccccccceeeeeccccccccccc
KGTVSPKKAVATLKIYNRSLKEEFNHFEDWLNVFPLYRGQGGQDGGEEGSGHLVGKFKGSFLIYPESEAVLFSEPQISRGIPQNRPIKLLVRVYVVKA
cccccccchhhhhhhhhhhhhhhhhhhhhhcccccccccccccccccceeeeeeccccccccccccccccchhhhhhhhhhh
TNLAPADPNGKADPYVVVSAGRERQDTKERYIPKQLNPIFGEILELSISLPAETELTVAVFDHDLVGSDDLIGETHIDLENRFYSHHRANCGLASQYEVD
ccccccccccccccccceeeeecccccccccccccchhccccccccccccceeeeccccccccchhhhhhhhhccccccccccccceecc
GYNAWRDAFWPSQILAGLCQRCGLPAPEYRAGAVKVGSKVFLTPPETLPPVASGDPEEAQALLVLRRWQEMPGFGIQLVPEHVETRPLYHPSPGLLQGS
cchhhhhhccchhhhhhhcccccccccccccccccccccccceeeecccccccchhhhhhhhhhhcccceeeeccccccccccccc
LHMWIDIFPQDVPAPPVDIKPRQPISYELRVVIWNTEDVVLDDENPLITGEMSSDIYVKSWVKGLEHDKQETDVHFNSLTGEGNFNWRFVFRFDYLPTER
ceeeeecccccccchhhhhhcccccccccccccccccccceeehhhhhhccchccccccccccccceeecccccccccceeeeeeeeccccccc
EVSVWRRSGPFALEEAEFRQPAVLVLQVWDYDRISANDFLGSLELQLPDMVRGARGPELCSVQLARNGAGPRCNLFRCRRLRGWPPVVKLKEAEDGKVEA
eeehhcccchhhhhcccccccccccccccceeeecccccccccccccccchhhhhhhccccccchehhhcccccccccceeeeccccccccchh
EFELLTVEEAEKRPVGKGRKQPEPLEKPSRPKTSFNWFVNPLKTFVFFIWRRYWRTLVLLLLVLLTVFLLLVFYTIPGQISQVIFRPLHK
hhhhhhhhhhcccccccccccccccchheeccchhhhhhhhhhhhhhhhhhhhhcccchhhhheeccccc
```

Figure 13H: Secondary structure prediction of 158P3D2 variant 17

```
         10        20        30        40        50        60        70        80        90       100
          |         |         |         |         |         |         |         |         |         |
MALTVSVQRLTGLTGTHDRQVKLTFRGFTQKTRKIHCGPEADIGELFRWPHYGAPLAGECLSVQVVNCSRVESLRPLGTLVISLQQLQNAGELVLREALV
ceeeeeeeeccccccchheeehecccchhheeccccchhheecccccccchhecccccceeeeeecccchhhhehhhchhhhhhhhhhhhhhhhhhhh
DENLQVSPIQVELDLKYQPPEGATGAWSEEDFGAPIQDSFELIIPNVGFQELEPGEAQLERRAVALGRRLARSLGQQDDEENELELELEQDLDDEPDVEL
cccccceeeecccccccccccccccccccccccchhheeecccccccccccccchhhhhhhhhccccccchhhhhhhcccccccchhhhhhccccccc
SGVMFSPLKSRARALAHGDPFQVSRAQDFQVGVTVLEAQKLVGVNINPYVAVQVGGQRRVTATQRGTSCPFYNEVFLFEFHDTRLRLQDLLEITVSGVG
cchhhhhhhhhhhhcccccceecccccccccccchhhhhhhhhhhccccceeeeeeccccccccccccchheeehhcccchhhhhheeeeeecccc
VTSVLQRRGDEKAAGLTPPSPKAFHSQTLPFMATRIGTFRMDLGIILDQPDGQFYQRWVPLHDPRDTRAGTKGFTKVTLSVRARGDLPPPMLPPAPGHCS
eeeeeeccccccccccccccccccccccchhhcccceeeeccccccccccccccccceeeeecccccceeeeeeeccccccccccccccccccccc
DIEKNLLLPRGVPAERPWARLRVRLYRAEGLPALRIGILLGSLVRAIHDQRVLVEPYVRVSFLGQFGETSVSAFAAAPEWNEQLSFVELFPPLTRSLRLQL
cccccccccccccccchhhhhhhhhhccccchhhhhhhhhccccccceeeeeccccccccccccchhhteehhhchhhhhhhhhhc
RDDAPLVDAALATHVPDLRRISHPGRAAGFNPTFGPAWVPLYGSPPGAGLRDSLQGLNEGVGQFWFRGRLLLAVSMQVLEGRAEPEPPQAQQGSTLSRL
ccccchhhhhhhccchhccccccccccccccccccccccchhhhhhhhhccccheeehhhhhhhhcccccccccccccccccccccchhhhhh
TRKKKKKARRDQTPKAVPQHLDASPGAEGPEIPRAMEVEVEELLPIPENVLAPCEDFLLFGVLFEATMIDPTVASQPISFEISIGRAGRLEEQLGRGSRA
hrhhhhhhcccccccccccccccccccccccchhhhhhhhhcccccccchhhhheheeeeehcccccccccceeeecccchhhhcccccccc
GEGTEGAAVEAQPLLGARPEEKEEEELGTHAQRPEPMDGSGPYFCLPLCHCKPCMHVWSCWEDHTWRLQSSNCVRKVAERLDQGLQEVERLQRKFGPGA
cccccchecccccccccccccccccccchhhhccccccccccccccccccccccccccccccchhhhhhhchchhhhhhhhchcccccc
CAQLKQALEVIVAGSRQFCHGAERRTMTRPNALDRCRGKLLIVHSLNLLAKQGLRLIRGLRRRNVQKKVALAKKLLAKLRFLAEEPQPPLPDVLVWMLSGQ
hrhhhhhhhhhcccchecccccccccccccchhcccchhhhhhhhhhhhhhhhhhhhhhhhhhhhcccccchtheehchc
RRVAWARIPAQDVLFSVVEEERGRDCGKIQSLMLITAPGAAPGEVCAKLELFLRLGIGKQAKACTSELPPDLLPEPSAGLPSSLHRDDFSYFQLRAHLYQA
hrhhhhccccchhneeheeeccccccccccceeeeccccccccccccccchcccccccccccccccccccchhhhhhhhc Alpha helix      (h):  32.86 %
                          Extended strand  (e):  14.69 %
                          Random coil      (c):  52.46 %
```

Figure 13H-2: Secondary structure prediction of 158P3D2 variant 17

```
        1010       1020       1030       1040       1050       1060       1070       1080       1090       1100
          |          |          |          |          |          |          |          |          |          |
RGVLAADDSGLSDPFARVLISTQCQTTRVLEQTLSPLWDELLVFEQLIVDGRREHLQEEPPLVIINVFDHNKFGPPVFLGRALAAPRVKLMEDPYQRPEL
cceeeccccchhhhhehccccchhhhhhhhhhhhhhhccchhccccccceeeeccccccchhhhhhhhhhhhhhhhccchhcccceeecccccccccc
QFFPLRKGPWAAGELIAAFQLIELDYSGRLEPSVPSEVEPQDLAPIVEPHSGRLSLPPNVCPVLREFRVEVLFWGLRGLGRVHLLEVEQPQVVLEVAGQG
ccccccccchhhhhhhhhhhhhhccccccccccccccccccccccccccchhhhhhhhhhhhhhhccccheeeeeeecccccccccccceeeeeccccc
VESEVLASYRESPNFTELVRHLTVVFKDTAPLFHPQDLPEQPYLQPPLSILVIERRAFGHTVLVGSHIVPHMLRFTFRGHEDPPEEEGEMEETGDMPKG
cheeehhccccccccchhehheeeecccccccceeecccccccchhhhhhhhhhheeeccccchhhhheheeecccccccccccccccccccccccccc
PQGQKSLDPFLAEAGISRQLLKPPLKKLPLGGLLNQGPGLEEDIPDPEELDWGSKYYASLQELQGQHNFDEDEMDDPGDSDGVNLISMVGEIQDQGEAEV
cccccchhhhhhcchhhhhccccccchhhhhhhhhhhhhccccccccccccccccccccccccccccccccceeeeeccccccccccccccccccccc
KGTVSPKKAVATLKIYNRSLKEEFNHFEDWLNVFPLYRGQGQDGGEEFGSHLVGKFKGSFLIYPESEAVLFSEPQISRGIPQNRPIKLLVRVYVVKA
ccccccchhhhhhhhhhhhhhhhhhhhccccccccccccccccceeeeeeccccccccceeeeecccccccccccccccccchhhhhhhhhhh
TNLAPADPNGKADPYVVVSAGRERQDTKERYIPKQLNPIFGEILELSISLPAETELTVAVFDHDLVGSDDLIGETHIDLENRFYSHHRANCGLASQYEVD
cccccccccccccccccceeeecccccccccchhhcccchhhhhhhheeeeccccccccccccchchchhhhhccccccccccccceec
GYNAWRDAFWPSQILAGLCQRCGLPAPEYRAGAVKVGSKVFLTPPETLPPGSSSPTVASGDPEEAQALLVLRRWQEMPGFGIQLVPEHVETRPLYHPHSP
cchhhhhhhcccchhhhhhccccccccccccccccccceeeeecccccccccccccccccccchhhhhhhcccceeeeccccccccccccccc
GLLQGSLHMWIDIFPQDVPAPPVDIKPRQPISYELRVVIWNTEDVVLDDENPLTGEMSSDIYVKSWVKGLEHDKQETDVHFNSLTGEGNFNWRFVFRFD
ccccccceeeeeccccccccccccccccccchheeehhhhhcccccccccccccccccccccccccccccccccccccceeeeeeeec
YLPTEREVSVWRRSGPFALEEAEFRQPAVLVLQVWDYDRISANDFLGSLEIQLPDMVRGARGPELCSVQLARNGAGPRCNLFRCRRLRGWWPVVKLKEAE
cccccceeehhccccchhhhhcccceeeeeccccccccccccchhhhhhhccchccccccccccchhhhhccccccccchhehhhccccceeeechh
DVEREAQEAQAGKKKRKQRRRKGRPEDLEFTDMGGNVYIILTGKVEAAEFELLTVEEAEKRPVGKGRKQPEPLEKPSRPKTSFNWFTVNPLKTFVFFIWRRYW
hhhhhhhhhhhccccchhhhhhccccccccccccccccceeeeeecceeerhhhhhhhhhhhccccccccccccccchhhhhhhhhh
RTIVLLLLVLLTVFELLLVFYTIPGQISQVIFRPLHK
hhhhhhhhhhhhhhhhhhhhccchhheecccc
```

Figure 13I: Secondary structure prediction of 158P3D2 variant 18

```
         10        20        30        40        50        60        70        80        90       100
          |         |         |         |         |         |         |         |         |         |
MCKRRWHWPRSSWQNCAFWLRRHPGQPLVRSVPSWSSSCGWAWASKPRPAPLSCPRICCPSPQPGCPPAYTGTVLEQTLSPLWDELLVFEQLIVDGRREH
cccccccccccccccchhhhhhhhhhhhcccccccccccccccceeccccccccccccccccccccccccccccccchhhhhhhhhhhhhhhcchhc
LQEEPPLVIINVFDHNKFGPPVFLGRALAAPRVKLMEDPYQRPELQFFFPLRKGPWAAGELIAAFQLIELDYSGRLEPSVPSEVEPQDLAPLVEPHSGRLS
ccccceeeeeeccccccccccccccccccccceeccccccccccchhccchhhhhhhhhhhhhhhhcccccccccccccccccccccccccccc
LPPNVCPVLREFRVEVLFWGLRGLGRVHLLEVEQPQVVLEVAGQGVESEVLASYRESPNFTELVRHLTVVFKDTAPLFHPQDLPEQPYLQPPLSILVIER
ccccchhhhhhhhhhhhhhhhhhhhhhccccheeehhcccccccccccccccccccccccccchhehheeeecccccccccccccccheeehhh
RAFGHTVLVGSHIVPHMLRFTFRGHEDPPEEGEMEETGDMMPKGPQGQKSLDPFLAEAGISRQLLKHNFDEDEMDDPGDSGVNLISMVGEIQDQGEAE
hhcccceeeecchhhhheeeccccccccccccccccccccccccchhhhhhhhhhhhhhhhhhhccccccccccccccccceeeeeeccccccccc
VKGTVSPKKAVATLKIYNRSLKEEFNHFEDWLNVFPLYRGQGGQDGGEEEGSGHLVGKFKGSFLIYPESEAVLFSEPQISRGIPQNRPIKLLVRVYVVK
cccccccccccccccccccccccccccccccccccccccccccceeeeccccccccccccccccccccccccccccccccchhhhhhhhhhh
ATNLAPADPNGKADPYVVSAGRERQDTKERYIPKQLNPIFGEILELSISLPAETELTVAVFDHDLVGSDDLIGETHIDLENRFYSHHRANCGLASQYEV
ccccccccccccccccccccccccccccccccccchhccchhhhhhccccccccccccccccccchchhhhhhhhcccccccccccccccceee
WVQQGPQEPF
eeeccccccc
```

Alpha helix (h) : 27.21 %
Extended strand (e) : 14.75 %
Random coil (c) : 58.03 %

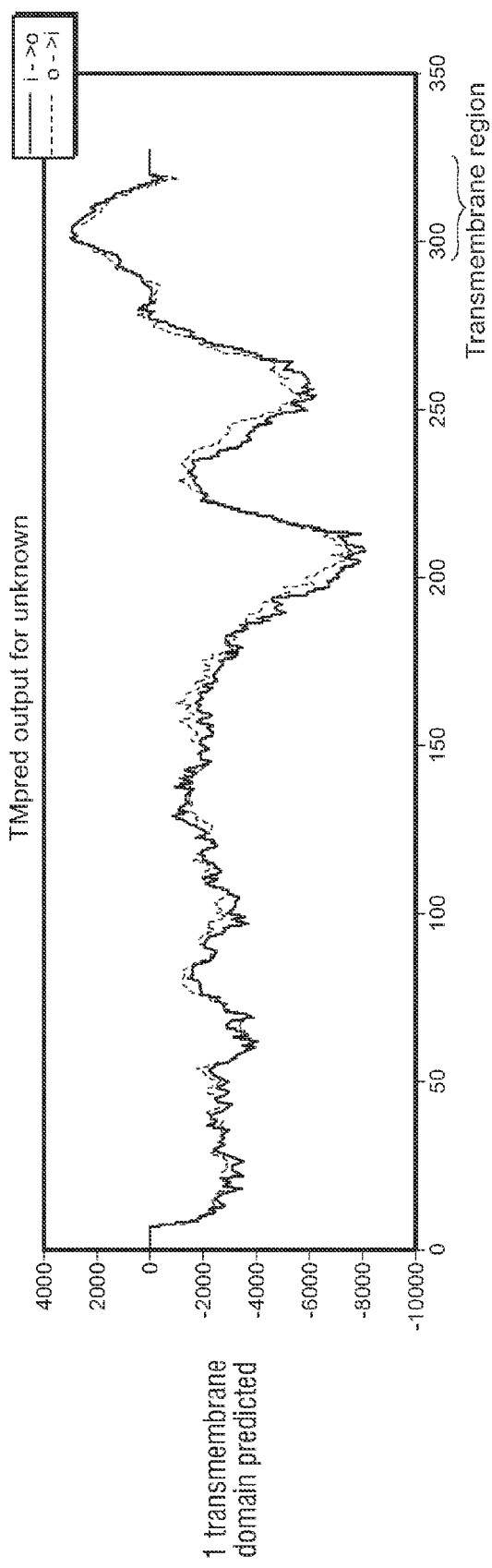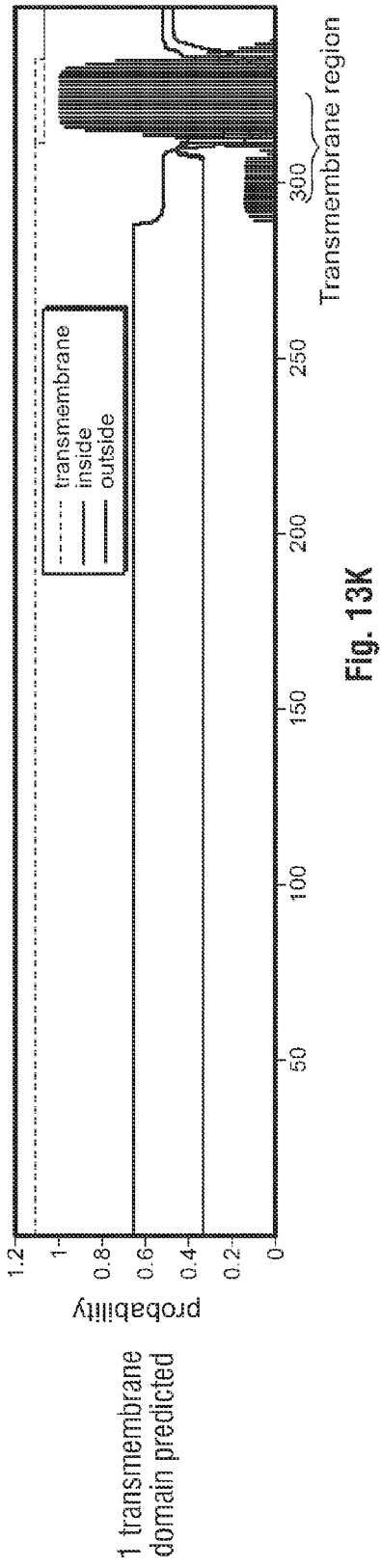
FIGURE 13: Transmembrane prediction for 158P3D2 variant 1
Fig. 13J
Fig. 13K

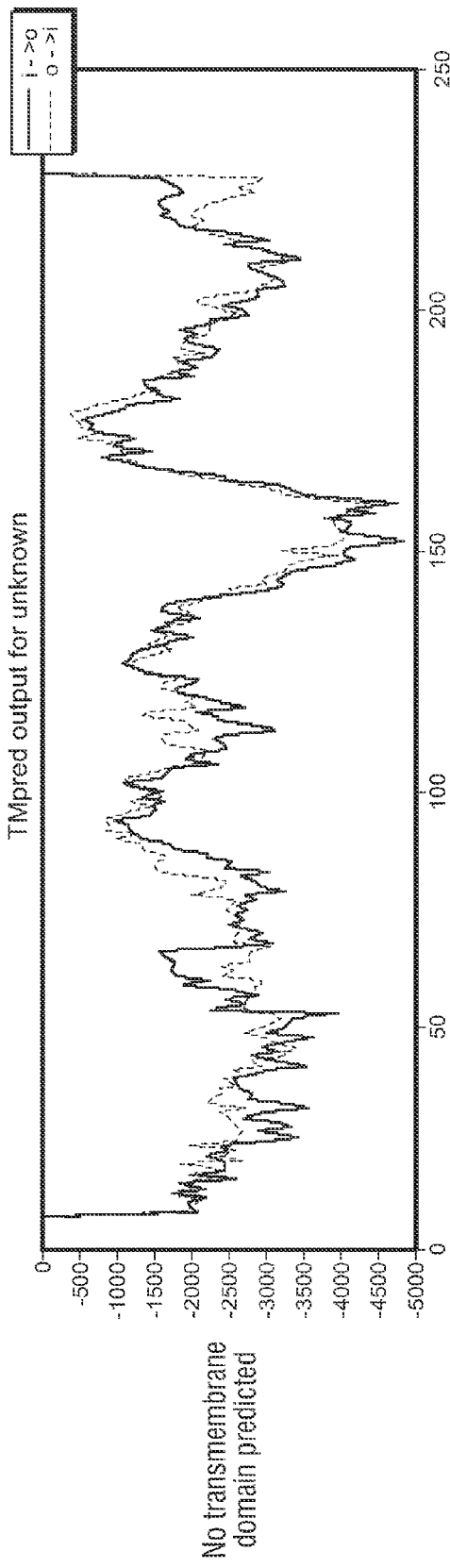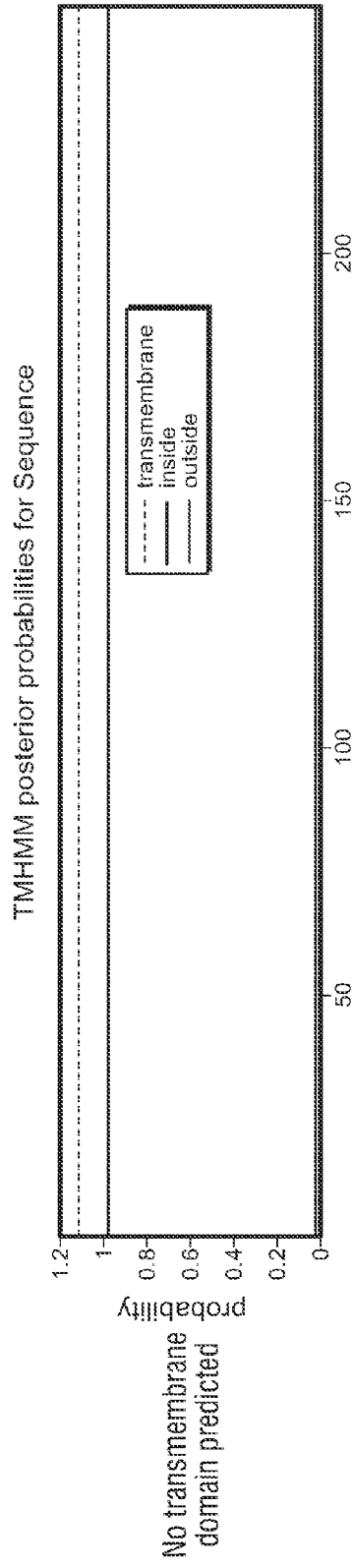

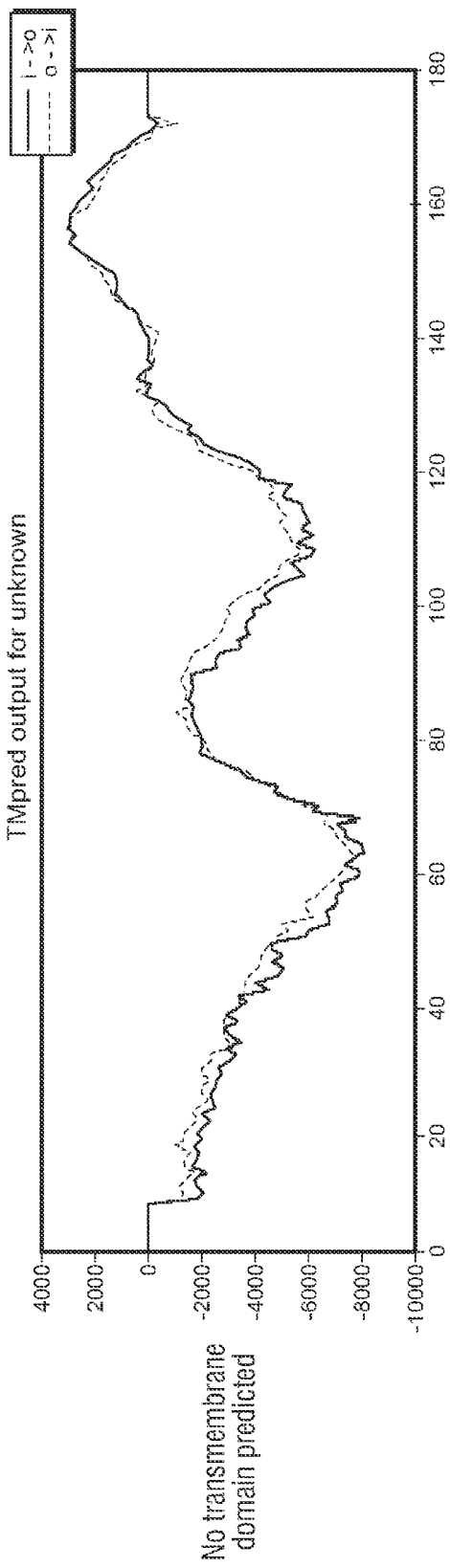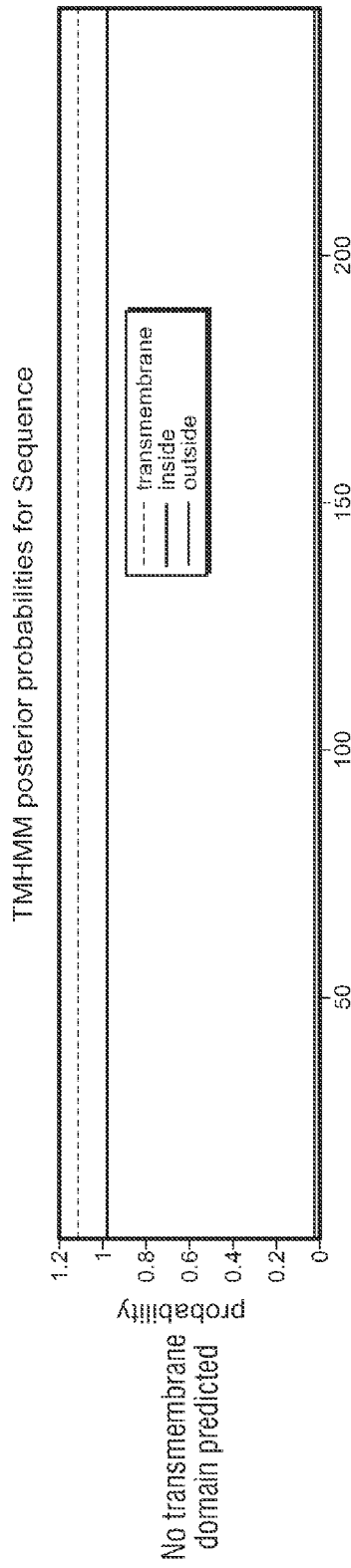
FIGURE 13: Transmembrane prediction for 158P3D2 variant 2b
Fig. 13N
Fig. 13O

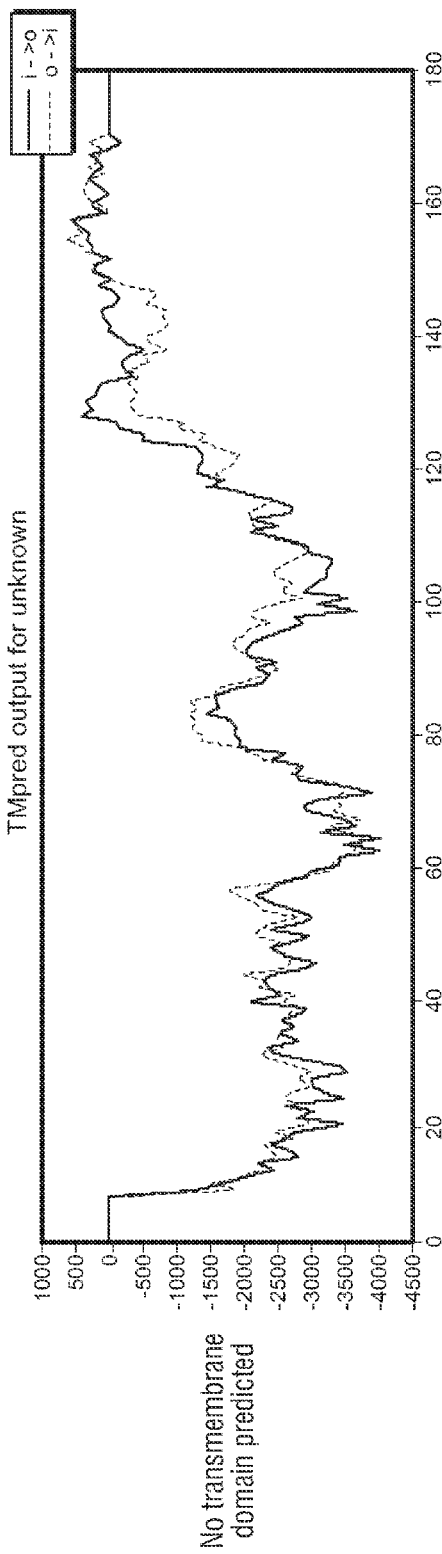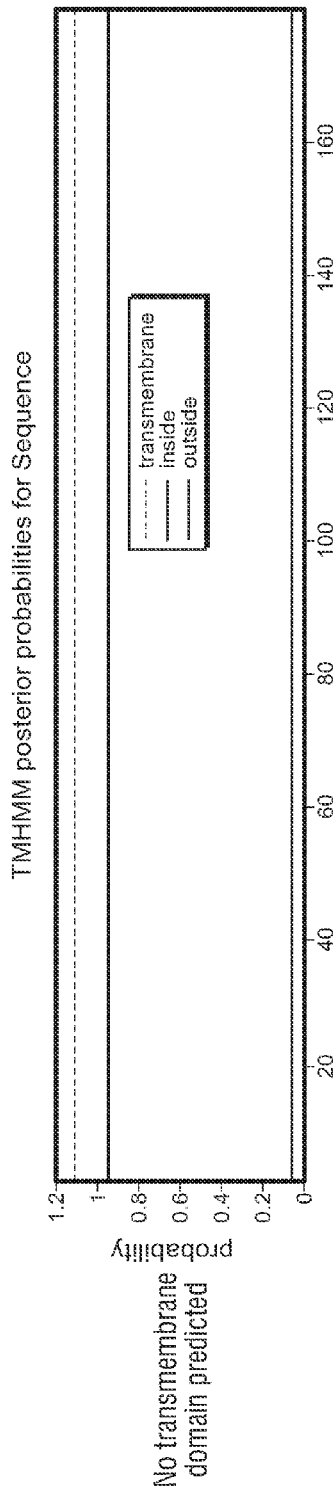
Fig. 13P
Fig. 13Q

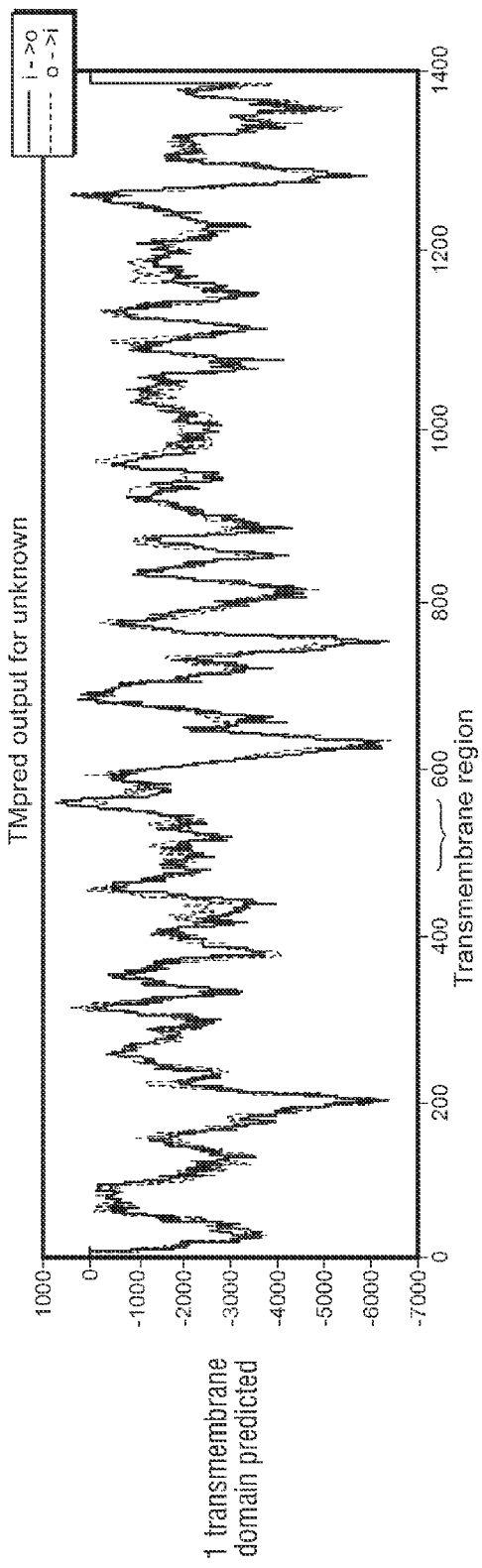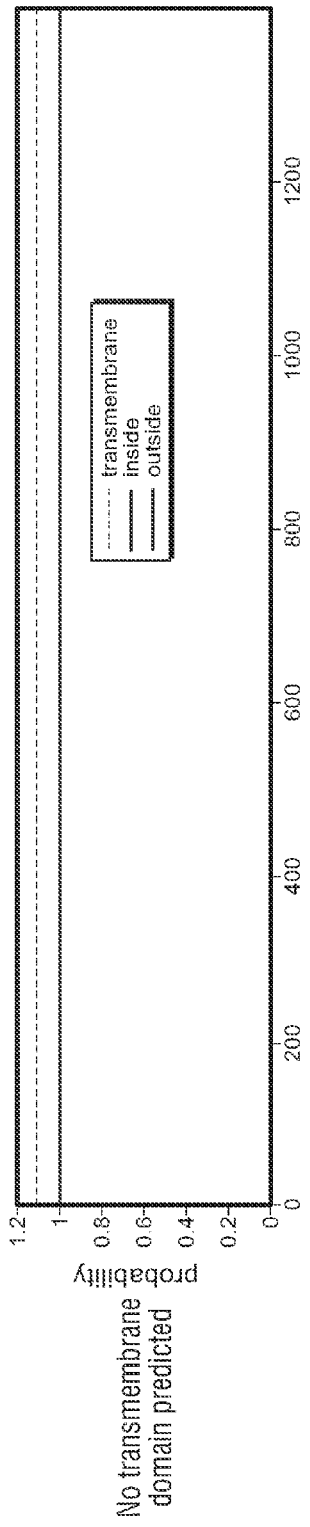

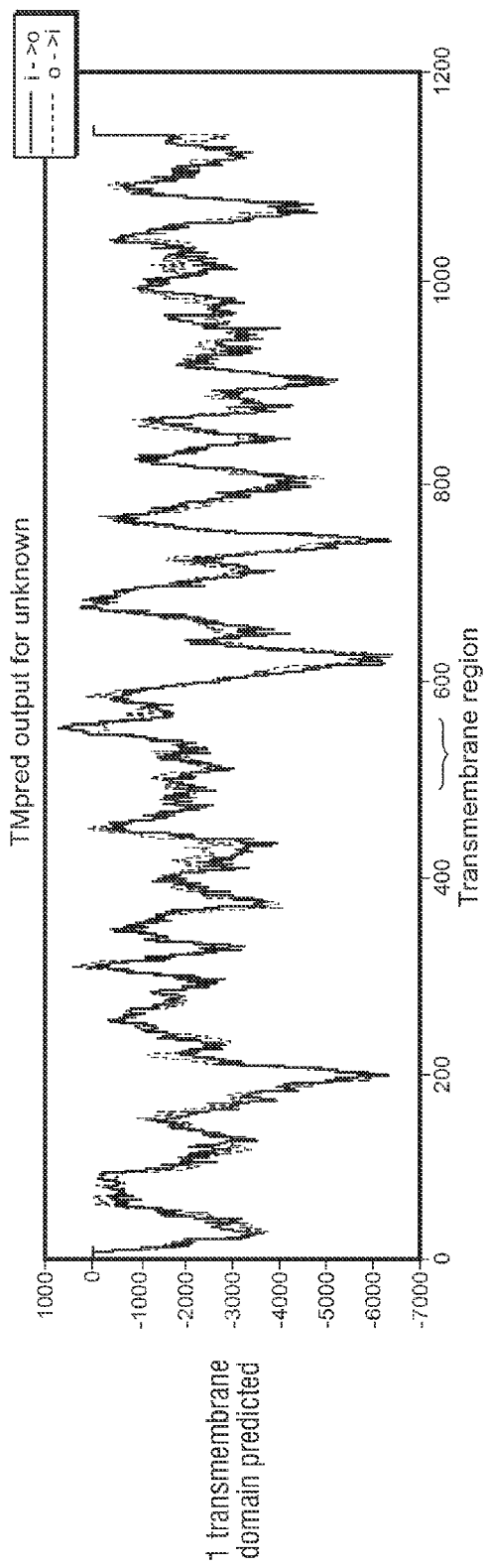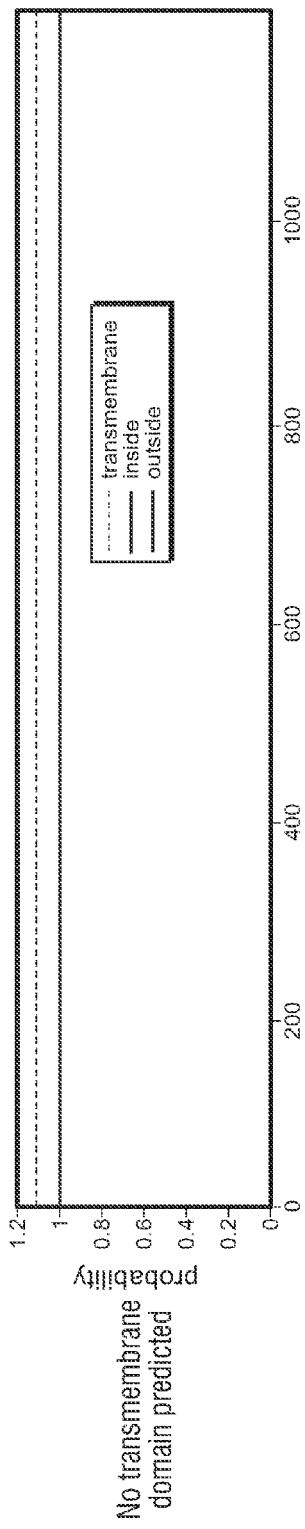

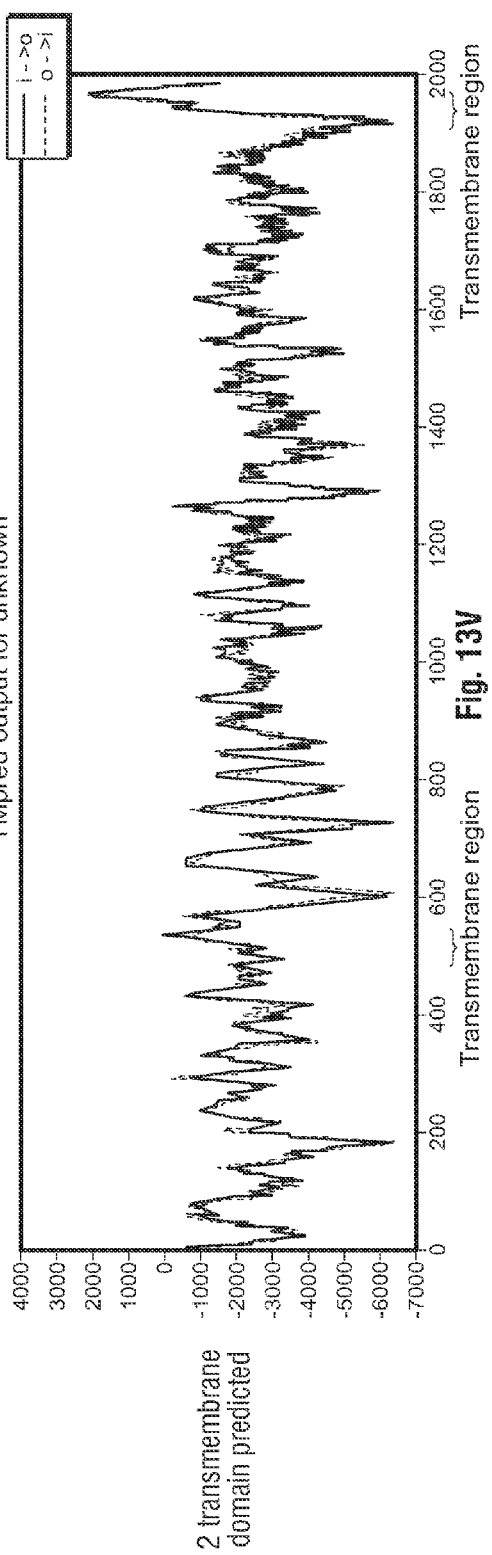
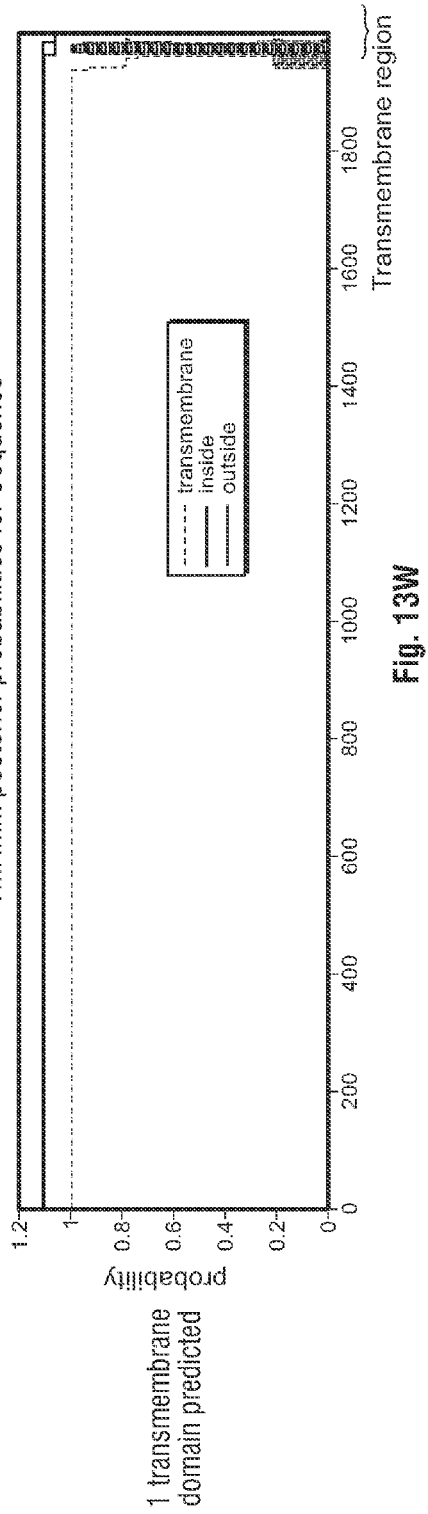

FIGURE 13: Transmembrane prediction for 158P3D2 variant 17

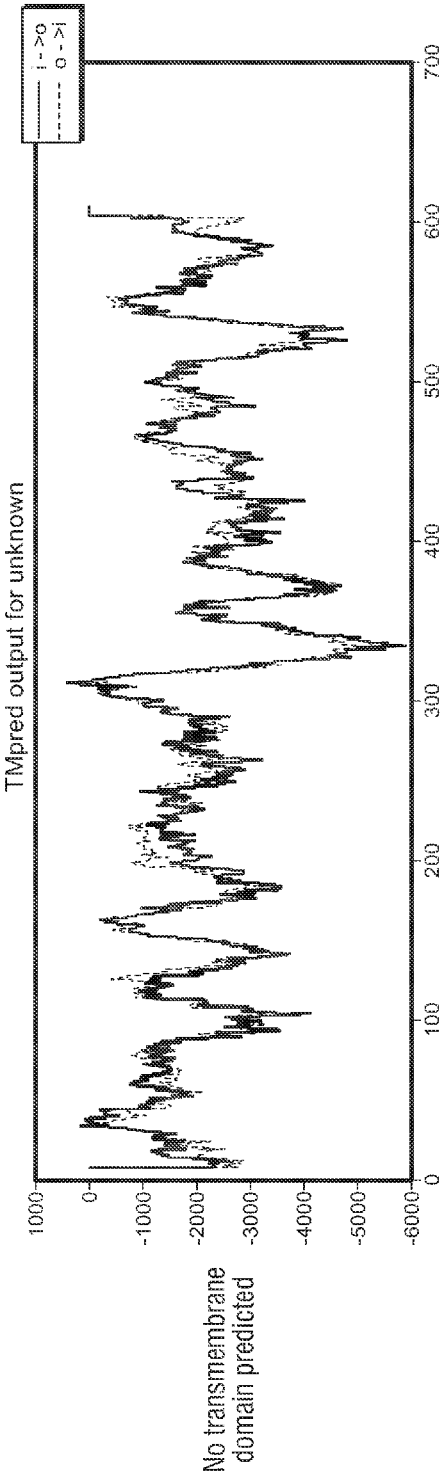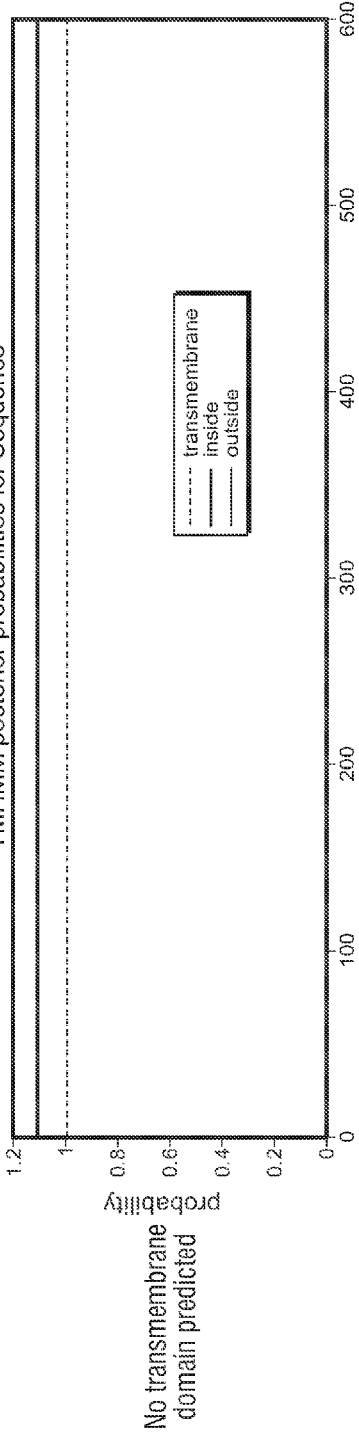

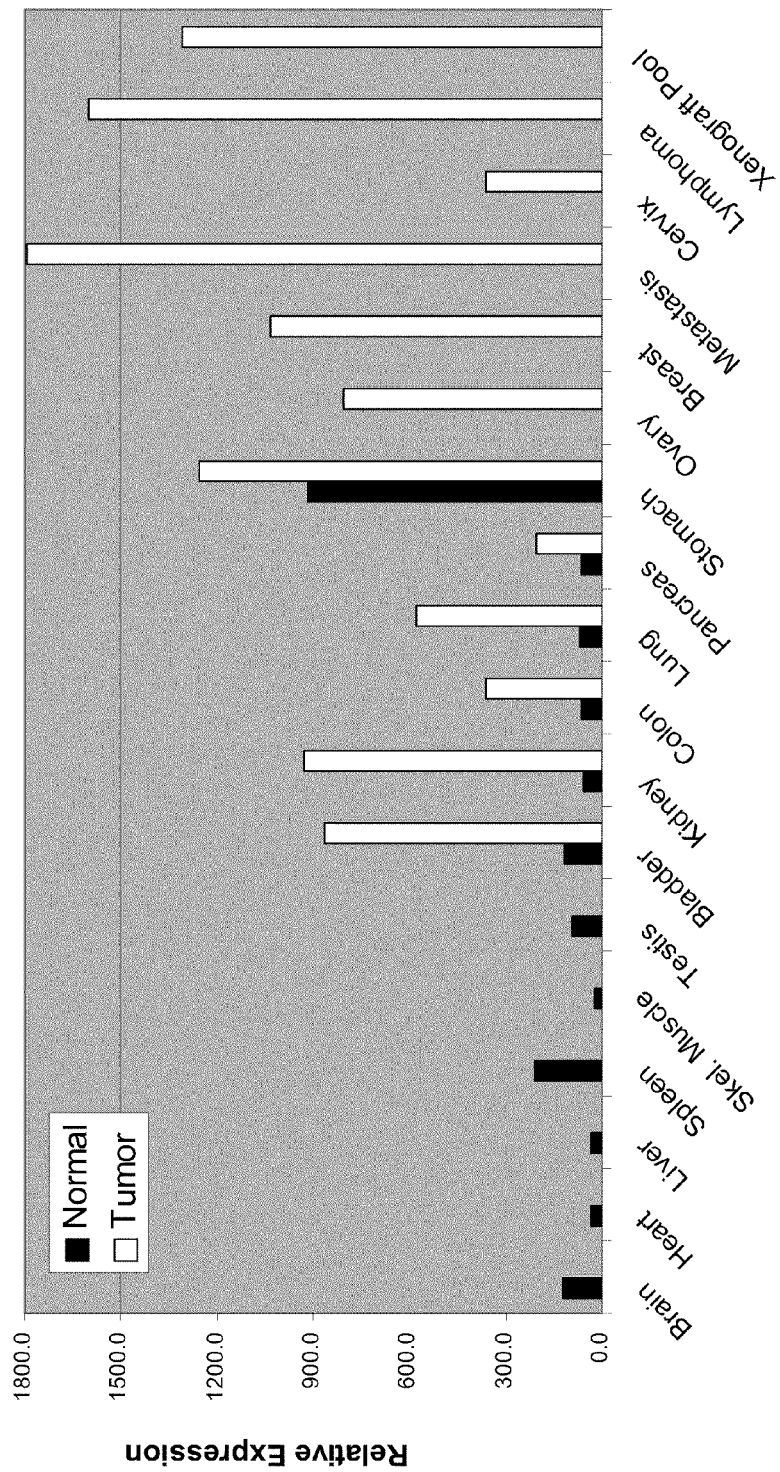
Figure 14 158P3D2 Expression in Normal and Cancer Tissue Specimens

158P3D2 Expression in Bladder Cancer Patient Specimens

Figure 16 158P3D2 Expression in Bladder Cancer Patient Samples by Northern Blotting

158P3D2 Expression in Lung Cancer Patient Specimens

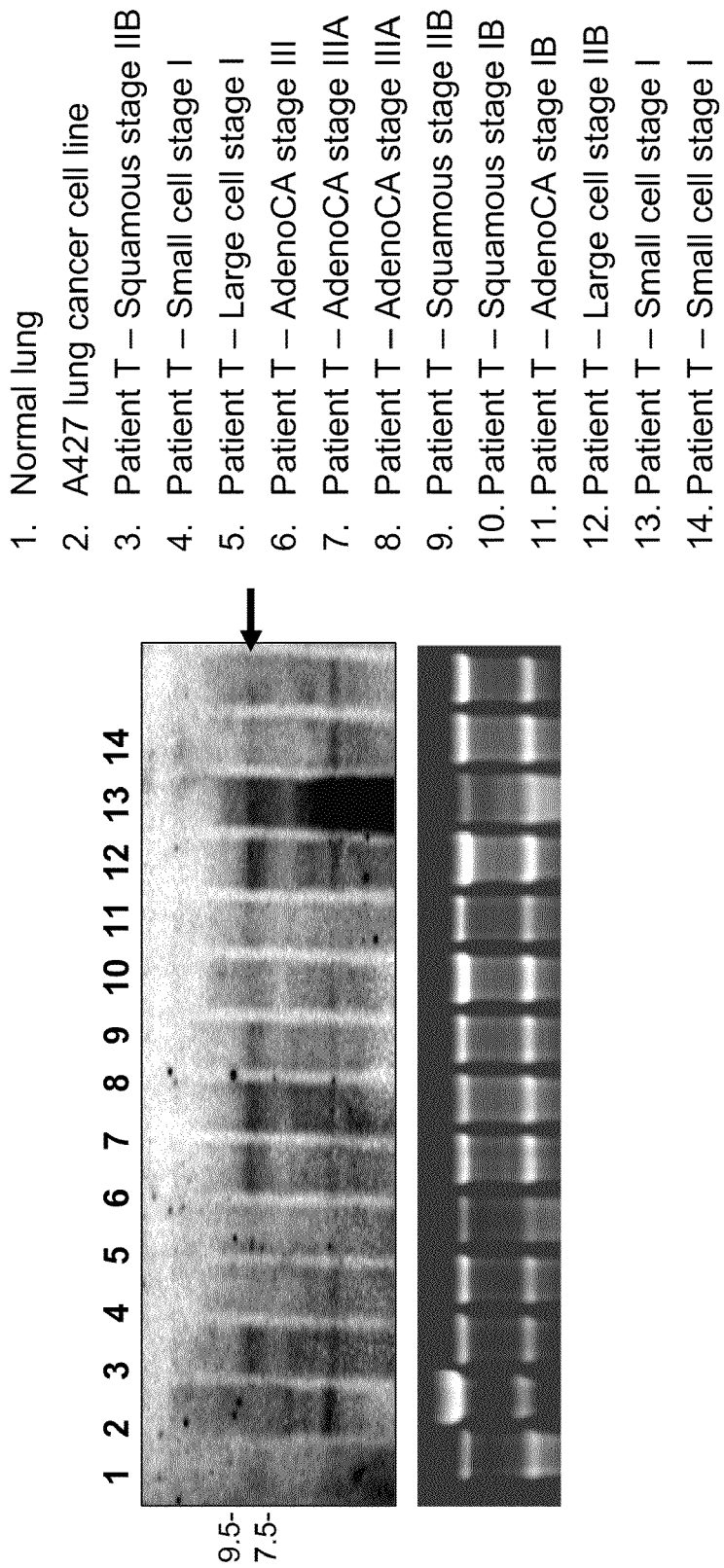

Figure 18 158P3D2 Expression in Lung Cancer Patient Specimens by Northern Blotting 1. Normal lung
2. A427 lung cancer cell line
3. Patient T – Squamous stage IIB
4. Patient T – Small cell stage I
5. Patient T – Large cell stage I
6. Patient T – AdenoCA stage III
7. Patient T – AdenoCA stage IIIA
8. Patient T – AdenoCA stage IIIA
9. Patient T – Squamous stage IIB
10. Patient T – Squamous stage IB
11. Patient T – AdenoCA stage IB
12. Patient T – Large cell stage IIB
13. Patient T – Small cell stage I
14. Patient T – Small cell stage I 158P3D2 Expression in Cancer Metastasis Patient Specimens

Figure 20
158P3D2 Expression in Cervical Cancer Patient Specimens

| Panel # | Diagnosis | Grade | Stage | 158P3D2 |
|---|---|---|---|---|
| 1 | Normal Cervix | | | 0 |
| 2 | HeLa cell line | | | 0 |
| 3 | Intraepithelial neoplasia | 2-3 | T3AN0MX | 1 |
| 4 | AdenoCA | 1 | IIA | |
| 5 | AdenoCA | 1 | IIA | 1 |
| 6 | AdenoCA | 2 | IIA | 2 |
| 7 | AdenoCA | 2 | IIB | 2 |
| 8 | Non-keratinizing squamous cell | 2 | T2aNXM0 | 1 |
| 9 | Non-keratinizing squamous cell | 2 | IIB | 1 |
| 10 | Mucinous AdenoCA | 2 | IIB | 1 |
| 11 | AdenoCA | 2 | T3bNXM0 | 1 |
| 12 | Adenosquamous | 2B | T2bNXM0 | 2 |
| 13 | AdenoCA | well diff. | III | 1 |
| 14 | AdenoCA | mod. diff. | III | 2 |
| 15 | Keratinizing squamous cell | 1 | | 2 |
| 16 | Keratinizing squamous cell | 2 | T2aNXM0 | 2 |

| | |
|---|---|
| 0 | Negative expression |
| 1 | Low expression |
| 2 | Medium expression |
| | High expression |

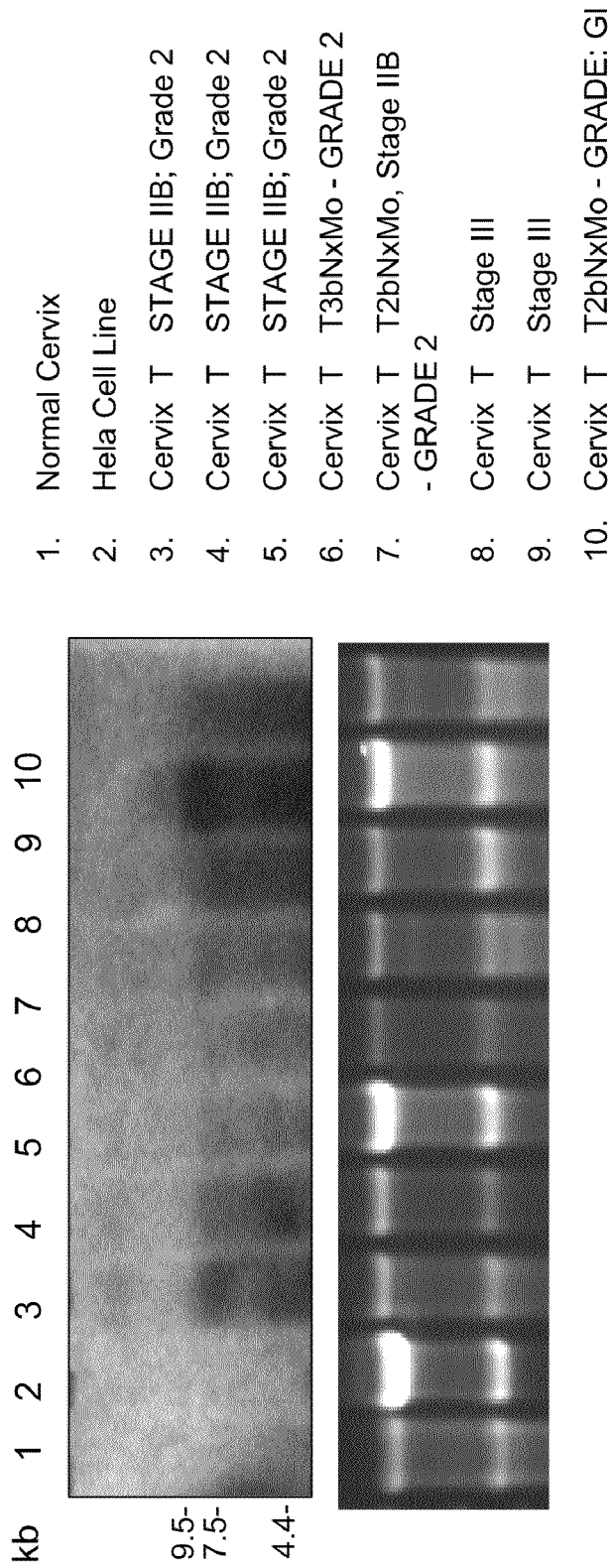
Figure 21 158P3D2 Expression in Cervical Cancer Patient Specimens by Northern blotting
1. Normal Cervix
2. Hela Cell Line
3. Cervix T STAGE IIB; Grade 2
4. Cervix T STAGE IIB; Grade 2
5. Cervix T STAGE IIB; Grade 2
6. Cervix T T3bNxMo - GRADE 2
7. Cervix T T2bNxMo, Stage IIB - GRADE 2
8. Cervix T Stage III
9. Cervix T Stage III
10. Cervix T T2bNxMo - GRADE: GI 158P3D2 Expression in Kidney Cancer Patient Specimens

Figure 23 158P3D2 Expression in Kidney Cancer Patient Specimens by Northern Blotting

| Lane # | Type | Grade |
|---|---|---|
| 1 | Normal Kidney Tissue | n/a |
| 2 | Clear | G2 |
| 3 | Clear | G2/4 |
| 4 | Clear | G2/3 |
| 5 | Chromophobe | G4 |
| 6 | Papillary | G3 |
| 7 | Clear | G3 |
| 8 | Chromophobe | G2 |
| 9 | Clear | G1 |
| 10 | Papillary | G2 |
| 11 | Papillary | S3 |

158P3D2 Expression in Stomach Cancer Patient Specimens

Figure 25 158P3D2 Expression in Stomach Cancer Patient Specimens by Northern Blotting

| # | Diagnosis | Grade | Stage |
|---|---|---|---|
| 1 | Normal Stomach | n/a | n/a |
| 2 | Metastasis to lymph node | 0 | 0 |
| 3 | AdenoCA | poorly diff. | T1N2MX |
| 4 | AdenoCA | IIIA | T3N1M0 |
| 5 | AdenoCA | well diff. | T3N0M0 |
| 6 | AdenoCA | I | T2N0M0 |
| 7 | Not determined | 0 | 0 |
| 8 | AdenoCA | I | T2N0M0 |
| 9 | AdenoCA | II | T3N1MX |
| 10 | AdenoCA | II | T2N1MX |

158P3D2 Expression in Colon Cancer Patient Specimens

158P3D2 Expression in Uterus Cancer Patient Specimens

| Panel# | Diagnosis | Grade | 158P3D2 |
|---|---|---|---|
| 1 | Normal Uterus | | 0 |
| 2 | AdenoCA | Well diff. | 2 |
| 3 | AdenoCA | G2 | 2 |
| 4 | AdenoCA | G1 | 1 |
| 5 | Stromal sarcoma | High grade | 1 |
| 6 | AdenoCA | G2 | 2 |
| 7 | AdenoCA | G1 | |
| 8 | AdenoCA | G1 | 2 |
| 9 | AdenoCA | G3A | |
| 10 | Carcinosarcoma | G3 | 0 |
| 11 | AdenoCA | G2 | 1 |
| 12 | AdenoCA | G2 | 2 |
| 13 | AdenoCA | G2 | 1 |

| | |
|---|---|
| 0 | Negative expression |
| 1 | Low expression |
| 2 | Medium expression |
| | High expression |

Figure 28
158P3D2 Expression in Breast Cancer Patient Specimens

| Panel # | Diagnosis | Grade | 158P3D2 |
|---|---|---|---|
| 1 | Normal breast | | 1 |
| 1B | Normal breast | | 1 |
| 1C | Normal breast | | 0 |
| 2 | MD-MBA-435S | | 1 |
| 3 | DU4475 | | 0 |
| 4 | MCF-7 | | 1 |
| 5 | CAMA-1 | | 0 |
| 6 | MCF10A | | 0 |
| 7 | Multi-focal infiltrating CA | 3 | 1 |
| 8 | Infiltrating ductal CA | 3 | 1 |
| 9 | ND | | 1 |
| 10 | Poorly diff. Ductal CA | 1-3 | 1 |
| 11 | Ductal in-situ | 3 | 1 |
| 12 | Invasive ductal CA | 2-3 | 1 |
| 13 | Invasive ductal CA | 3 | 0 |
| 14 | Infiltrating ductal CA | 3 | 1 |
| 15 | AdenoCA | 2 | 1 |
| 16 | Infiltrating lobulal CA | 3 | 1 |
| 17 | Infiltrating ductal CA | 3 | 1 |
| 18 | Infiltrating & in-situ CA | 2 | 1 |
| 19 | Infiltrating ductal CA | 3 | 2 |
| 20 | Intraductal and infiltrating ductal CA | 3 | |
| 21 | Non-invasive papillary CA | 2 | 2 |
| 22 | Infiltrating ductal CA | 2 | 2 |
| 23 | Infiltrating ductal CA | 3 | 2 |
| 24 | Invasive ductal CA | 2 | 2 |
| 25 | Infiltrating ductal CA | 3 | 1 |
| 26 | Infiltrating ductal with lobular features CA | 3 | 2 |

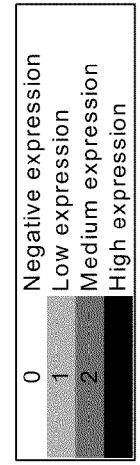

| | |
|---|---|
| 0 | Negative expression |
| 1 | Low expression |
| 2 | Medium expression |
| | High expression |

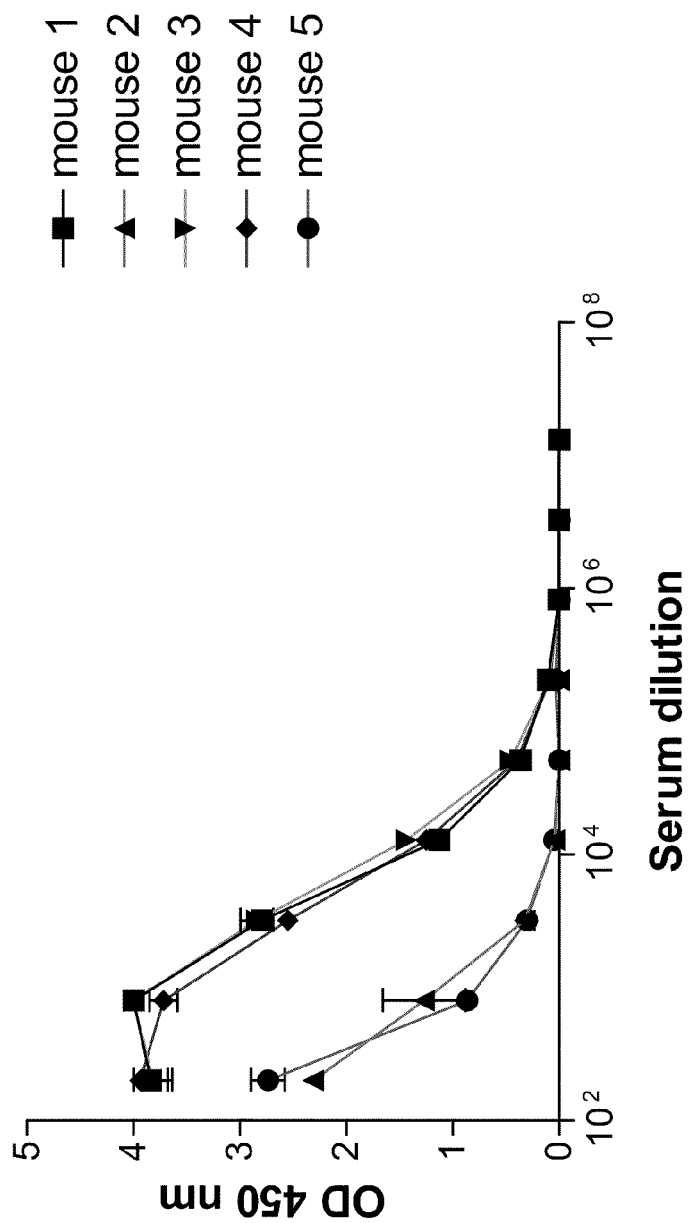
Figure 29: Serum titer of mice immunized with KLH-peptide encoding amino acids 315-328 of 158P3D2

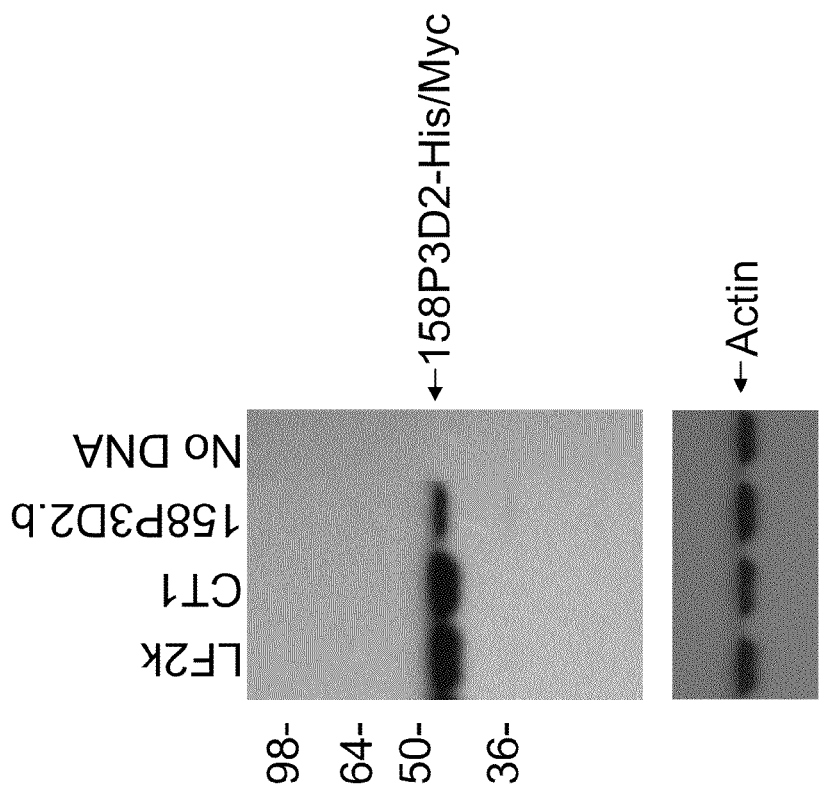
Figure 30: Validation of 158P3D2 siRNA oligo

NUCLEIC ACIDS AND CORRESPONDING PROTEINS ENTITLED 158P3D2 USEFUL IN TREATMENT AND DETECTION OF CANCER

CROSS-REFERENCE TO RELATED APPLICATIONS

This application is a continuation of U.S. patent application Ser. No. 10/994,106, filed Nov. 19, 2004, now U.S. Pat. No. 7,811,575, which is a continuation-in-part of U.S. patent application Ser. No. 10/107,532, filed Mar. 25, 2002, now abandoned, which claims priority to U.S. Provisional Patent Application No. 60/283,112, filed Apr. 10, 2001, and U.S. Provisional Patent Application No. 60/286,630, filed Apr. 25, 2001. The contents of the applications listed in this paragraph are fully incorporated by reference herein.

STATEMENT OF RIGHTS TO INVENTIONS MADE UNDER FEDERALLY SPONSORED RESEARCH

Not applicable.

REFERENCE TO SEQUENCE LISTING SUBMITTED VIA EFS-WEB

The entire content of the following electronic submission of the sequence listing via the USPTO EFS-WEB server, as authorized and set forth in MPEP §1730 II.B.2(a)(A), is incorporated herein by reference in its entirety for all purposes. The sequence listing is identified on the electronically filed text file as follows:

| File Name | Date of Creation | Size (bytes) |
|---|---|---|
| 511582006402Seqlist.txt | Sep. 9, 2010 | 718,856 bytes |

FIELD OF THE INVENTION

The invention described herein relates to genes and their encoded proteins, termed 158P3D2 and variants thereof, expressed in certain cancers, and to diagnostic and therapeutic methods and compositions useful in the management of cancers that express 158P3D2.

BACKGROUND OF THE INVENTION

Cancer is the second leading cause of human death next to coronary disease. Worldwide, millions of people die from cancer every year. In the United States alone, as reported by the American Cancer Society, cancer causes the death of well over a half-million people annually, with over 1.2 million new cases diagnosed per year. While deaths from heart disease have been declining significantly, those resulting from cancer generally are on the rise. In the early part of the next century, cancer is predicted to become the leading cause of death.

Worldwide, several cancers stand out as the leading killers. In particular, carcinomas of the lung, prostate, breast, colon, pancreas, and ovary represent the primary causes of cancer death. These and virtually all other carcinomas share a common lethal feature. With very few exceptions, metastatic disease from a carcinoma is fatal. Moreover, even for those cancer patients who initially survive their primary cancers, common experience has shown that their lives are dramatically altered. Many cancer patients experience strong anxieties driven by the awareness of the potential for recurrence or treatment failure. Many cancer patients experience physical debilitations following treatment. Furthermore, many cancer patients experience a recurrence.

Worldwide, prostate cancer is the fourth most prevalent cancer in men. In North America and Northern Europe, it is by far the most common cancer in males and is the second leading cause of cancer death in men. In the United States alone, well over 30,000 men die annually of this disease—second only to lung cancer. Despite the magnitude of these figures, there is still no effective treatment for metastatic prostate cancer. Surgical prostatectomy, radiation therapy, hormone ablation therapy, surgical castration and chemotherapy continue to be the main treatment modalities. Unfortunately, these treatments are ineffective for many and are often associated with undesirable consequences.

On the diagnostic front, the lack of a prostate tumor marker that can accurately detect early-stage, localized tumors remains a significant limitation in the diagnosis and management of this disease. Although the serum prostate specific antigen (PSA) assay has been a very useful tool, however its specificity and general utility is widely regarded as lacking in several important respects.

Progress in identifying additional specific markers for prostate cancer has been improved by the generation of prostate cancer xenografts that can recapitulate different stages of the disease in mice. The LAPC (Los Angeles Prostate Cancer) xenografts are prostate cancer xenografts that have survived passage in severe combined immune deficient (SCID) mice and have exhibited the capacity to mimic the transition from androgen dependence to androgen independence (Klein et al., 1997, Nat. Med. 3:402). More recently identified prostate cancer markers include PCTA-1 (Su et al., 1996, Proc. Natl. Acad. Sci. USA 93: 7252), prostate-specific membrane (PSM) antigen (Pinto et al., Clin Cancer Res 1996 Sep. 2 (9): 1445-51), STEAP (Hubert, et al., Proc Natl Acad Sci USA. 1999 Dec. 7; 96(25): 14523-8) and prostate stem cell antigen (PSCA) (Reiter et al., 1998, Proc. Natl. Acad. Sci. USA 95: 1735).

While previously identified markers such as PSA, PSM, PCTA and PSCA have facilitated efforts to diagnose and treat prostate cancer, there is need for the identification of additional markers and therapeutic targets for prostate and related cancers in order to further improve diagnosis and therapy.

Renal cell carcinoma (RCC) accounts for approximately 3 percent of adult malignancies. Once adenomas reach a diameter of 2 to 3 cm, malignant potential exists. In the adult, the two principal malignant renal tumors are renal cell adenocarcinoma and transitional cell carcinoma of the renal pelvis or urethras. The incidence of renal cell adenocarcinoma is estimated at more than 29,000 cases in the United States, and more than 11,600 patients died of this disease in 1998. Transitional cell carcinoma is less frequent, with an incidence of approximately 500 cases per year in the United States.

Surgery has been the primary therapy for renal cell adenocarcinoma for many decades. Until recently, metastatic disease has been refractory to any systemic therapy. With recent developments in systemic therapies, particularly immunotherapies, metastatic renal cell carcinoma may be approached aggressively in appropriate patients with a possibility of durable responses. Nevertheless, there is a remaining need for effective therapies for these patients.

Of all new cases of cancer in the United States, bladder cancer represents approximately 5 percent in men (fifth most common neoplasm) and 3 percent in women (eighth most common neoplasm). The incidence is increasing slowly, concurrent with an increasing older population. In 1998, there was an estimated 54,500 cases, including 39,500 in men and 15,000 in women. The age-adjusted incidence in the United States is 32 per 100,000 for men and eight per 100,000 in women. The historic male/female ratio of 3:1 may be decreasing related to smoking patterns in women. There were an estimated 11,000 deaths from bladder cancer in 1998 (7,800 in men and 3,900 in women). Bladder cancer incidence and mortality strongly increase with age and will be an increasing problem as the population becomes more elderly.

Most bladder cancers recur in the bladder. Bladder cancer is managed with a combination of transurethral resection of the bladder (TUR) and intravesical chemotherapy or immunotherapy. The multifocal and recurrent nature of bladder cancer points out the limitations of TUR. Most muscle-invasive cancers are not cured by TUR alone. Radical cystectomy and urinary diversion is the most effective means to eliminate the cancer but carry an undeniable impact on urinary and sexual function. There continues to be a significant need for treatment modalities that are beneficial for bladder cancer patients.

An estimated 130,200 cases of colorectal cancer occurred in 2000 in the United States, including 93,800 cases of colon cancer and 36,400 of rectal cancer. Colorectal cancers are the third most common cancers in men and women. Incidence rates declined significantly during 1992-1996 (−2.1% per year). Research suggests that these declines have been due to increased screening and polyp removal, preventing progression of polyps to invasive cancers. There were an estimated 56,300 deaths (47,700 from colon cancer, 8,600 from rectal cancer) in 2000, accounting for about 11% of all U.S. cancer deaths.

At present, surgery is the most common form of therapy for colorectal cancer, and for cancers that have not spread, it is frequently curative. Chemotherapy, or chemotherapy plus radiation, is given before or after surgery to most patients whose cancer has deeply perforated the bowel wall or has spread to the lymph nodes. A permanent colostomy (creation of an abdominal opening for elimination of body wastes) is occasionally needed for colon cancer and is infrequently required for rectal cancer. There continues to be a need for effective diagnostic and treatment modalities for colorectal cancer.

There were an estimated 164,100 new cases of lung and bronchial cancer in 2000, accounting for 14% of all U.S. cancer diagnoses. The incidence rate of lung and bronchial cancer is declining significantly in men, from a high of 86.5 per 100,000 in 1984 to 70.0 in 1996. In the 1990s, the rate of increase among women began to slow. In 1996, the incidence rate in women was 42.3 per 100,000.

Lung and bronchial cancer caused an estimated 156,900 deaths in 2000, accounting for 28% of all cancer deaths. During 1992-1996, mortality from lung cancer declined significantly among men (−1.7% per year) while rates for women were still significantly increasing (0.9% per year). Since 1987, more women have died each year of lung cancer than breast cancer, which, for over 40 years, was the major cause of cancer death in women. Decreasing lung cancer incidence and mortality rates most likely resulted from decreased smoking rates over the previous 30 years; however, decreasing smoking patterns among women lag behind those of men. Of concern, although the declines in adult tobacco use have slowed, tobacco use in youth is increasing again.

Treatment options for lung and bronchial cancer are determined by the type and stage of the cancer and include surgery, radiation therapy, and chemotherapy. For many localized cancers, surgery is usually the treatment of choice. Because the disease has usually spread by the time it is discovered, radiation therapy and chemotherapy are often needed in combination with surgery. Chemotherapy alone or combined with radiation is the treatment of choice for small cell lung cancer; on this regimen, a large percentage of patients experience remission, which in some cases is long lasting. There is however, an ongoing need for effective treatment and diagnostic approaches for lung and bronchial cancers.

An estimated 182,800 new invasive cases of breast cancer were expected to occur among women in the United States during 2000. Additionally, about 1,400 new cases of breast cancer were expected to be diagnosed in men in 2000. After increasing about 4% per year in the 1980s, breast cancer incidence rates in women have leveled off in the 1990s to about 110.6 cases per 100,000.

In the U.S. alone, there were an estimated 41,200 deaths (40,800 women, 400 men) in 2000 due to breast cancer. Breast cancer ranks second among cancer deaths in women. According to the most recent data, mortality rates declined significantly during 1992-1996 with the largest decreases in younger women, both white and black. These decreases were probably the result of earlier detection and improved treatment.

Taking into account the medical circumstances and the patient's preferences, treatment of breast cancer may involve lumpectomy (local removal of the tumor) and removal of the lymph nodes under the arm; mastectomy (surgical removal of the breast) and removal of the lymph nodes under the arm; radiation therapy; chemotherapy; or hormone therapy. Often, two or more methods are used in combination. Numerous studies have shown that, for early stage disease, long-term survival rates after lumpectomy plus radiotherapy are similar to survival rates after modified radical mastectomy. Significant advances in reconstruction techniques provide several options for breast reconstruction after mastectomy. Recently, such reconstruction has been done at the same time as the mastectomy.

Local excision of ductal carcinoma in situ (DCIS) with adequate amounts of surrounding normal breast tissue may prevent the local recurrence of the DCIS. Radiation to the breast and/or tamoxifen may reduce the chance of DCIS occurring in the remaining breast tissue. This is important because DCIS, if left untreated, may develop into invasive breast cancer. Nevertheless, there are serious side effects or sequelae to these treatments. There is, therefore, a need for efficacious breast cancer treatments.

There were an estimated 23,100 new cases of ovarian cancer in the United States in 2000. It accounts for 4% of all cancers among women and ranks second among gynecologic cancers. During 1992-1996, ovarian cancer incidence rates were significantly declining. Consequent to ovarian cancer, there were an estimated 14,000 deaths in 2000. Ovarian cancer causes more deaths than any other cancer of the female reproductive system.

Surgery, radiation therapy, and chemotherapy are treatment options for ovarian cancer. Surgery usually includes the removal of one or both ovaries, the fallopian tubes (salpingo-oophorectomy), and the uterus (hysterectomy). In some very early tumors, only the involved ovary will be removed, especially in young women who wish to have children. In advanced disease, an attempt is made to remove all intra-abdominal disease to enhance the effect of chemotherapy. There continues to be an important need for effective treatment options for ovarian cancer.

There were an estimated 28,300 new cases of pancreatic cancer in the United States in 2000. Over the past 20 years, rates of pancreatic cancer have declined in men. Rates among women have remained approximately constant but may be beginning to decline. Pancreatic cancer caused an estimated 28,200 deaths in 2000 in the United States. Over the past 20 years, there has been a slight but significant decrease in mortality rates among men (about −0.9% per year) while rates have increased slightly among women.

Surgery, radiation therapy, and chemotherapy are treatment options for pancreatic cancer. These treatment options can extend survival and/or relieve symptoms in many patients but are not likely to produce a cure for most. There is a significant need for additional therapeutic and diagnostic options for pancreatic cancer.

SUMMARY OF THE INVENTION

The present invention relates to a gene, designated 158P3D2, that has now been found to be over-expressed in the cancer(s) listed in Table I. Northern blot expression analysis of 158P3D2 gene expression in normal tissues shows a restricted expression pattern in adult tissues. The nucleotide (FIG. 2) and amino acid (FIG. 2, and FIG. 3) sequences of 158P3D2 are provided. The tissue-related profile of 158P3D2 in normal adult tissues, combined with the over-expression observed in the tissues listed in Table I, shows that 158P3D2 is aberrantly over-expressed in at least some cancers, and thus serves as a useful diagnostic, prophylactic, prognostic, and/or therapeutic target for cancers of the tissue(s) such as those listed in Table I.

The invention provides polynucleotides corresponding or complementary to all or part of the 158P3D2 genes, mRNAs, and/or coding sequences, preferably in isolated form, including polynucleotides encoding 158P3D2-related proteins and fragments of 4, 5, 6, 7, 8, 9, 10, 11, 12, 13, 14, 15, 16, 17, 18, 19, 20, 21, 22, 23, 24, 25, or more than 25 contiguous amino acids; at least 30, 35, 40, 45, 50, 55, 60, 65, 70, 80, 85, 90, 95, 100 or more than 100 contiguous amino acids of a 158P3D2-related protein, as well as the peptides/proteins themselves; DNA, RNA, DNA/RNA hybrids, and related molecules, polynucleotides or oligonucleotides complementary or having at least a 90% homology to the 158P3D2 genes or mRNA sequences or parts thereof, and polynucleotides or oligonucleotides that hybridize to the 158P3D2 genes, mRNAs, or to 158P3D2-encoding polynucleotides. Also provided are means for isolating cDNAs and the genes encoding 158P3D2. Recombinant DNA molecules containing 158P3D2 polynucleotides, cells transformed or transduced with such molecules, and host-vector systems for the expression of 158P3D2 gene products are also provided. The invention further provides antibodies that bind to 158P3D2 proteins and polypeptide fragments thereof, including polyclonal and monoclonal antibodies, murine and other mammalian antibodies, chimeric antibodies, humanized and fully human antibodies, and antibodies labeled with a detectable marker or therapeutic agent. In certain embodiments, there is a proviso that the entire nucleic acid sequence of FIG. 2 is not encoded and/or the entire amino acid sequence of FIG. 2 is not prepared. In certain embodiments, the entire nucleic acid sequence of FIG. 2 is encoded and/or the entire amino acid sequence of FIG. 2 is prepared, either of which are in respective human unit dose forms.

The invention further provides methods for detecting the presence and status of 158P3D2 polynucleotides and proteins in various biological samples, as well as methods for identifying cells that express 158P3D2. A typical embodiment of this invention provides methods for monitoring 158P3D2 gene products in a tissue or hematology sample having or suspected of having some form of growth dysregulation such as cancer.

The invention further provides various immunogenic or therapeutic compositions and strategies for treating cancers that express 158P3D2 such as cancers of tissues listed in Table I, including therapies aimed at inhibiting the transcription, translation, processing or function of 158P3D2 as well as cancer vaccines. In one aspect, the invention provides compositions, and methods comprising them, for treating a cancer that expresses 158P3D2 in a human subject wherein the composition comprises a carrier suitable for human use and a human unit dose of one or more than one agent that inhibits the production or function of 158P3D2. Preferably, the carrier is a uniquely human carrier. In another aspect of the invention, the agent is a moiety that is immunoreactive with 158P3D2 protein. Non-limiting examples of such moieties include, but are not limited to, antibodies (such as single chain, monoclonal, polyclonal, humanized, chimeric, or human antibodies), functional equivalents thereof (whether naturally occurring or synthetic), and combinations thereof. The antibodies can be conjugated to a diagnostic or therapeutic moiety. In another aspect, the agent is a small molecule as defined herein.

In another aspect, the agent comprises one or more than one peptide which comprises a cytotoxic T lymphocyte (CTL) epitope that binds an HLA class I molecule in a human to elicit a CTL response to 158P3D2 and/or one or more than one peptide which comprises a helper T lymphocyte (HTL) epitope which binds an HLA class II molecule in a human to elicit an HTL response. The peptides of the invention may be on the same or on one or more separate polypeptide molecules. In a further aspect of the invention, the agent comprises one or more than one nucleic acid molecule that expresses one or more than one of the CTL or HTL response stimulating peptides as described above. In yet another aspect of the invention, the one or more than one nucleic acid molecule may express a moiety that is immunologically reactive with 158P3D2 as described above. The one or more than one nucleic acid molecule may also be, or encodes, a molecule that inhibits production of 158P3D2. Non-limiting examples of such molecules include, but are not limited to, those complementary to a nucleotide sequence essential for production of 158P3D2 (e.g. antisense sequences or molecules that form a triple helix with a nucleotide double helix essential for 158P3D2 production) or a ribozyme effective to lyse 158P3D2 mRNA.

Note that to determine the starting position of any peptide set forth in Tables VIII-XXI and XXII to XLIX (collectively HLA Peptide Tables) respective to its parental protein, e.g., variant 1, variant 2, etc., reference is made to three factors: the particular variant, the length of the peptide in an HLA Peptide Table, and the Search Peptides in Table VII. Generally, a unique Search Peptide is used to obtain HLA peptides of a particular for a particular variant. The position of each Search Peptide relative to its respective parent molecule is listed in Table VII. Accordingly, if a Search Peptide begins at position "X", one must add the value "X−1" to each position in Tables VIII-XXI and XXII to XLIX to obtain the actual position of the HLA peptides in their parental molecule. For example, if a particular Search Peptide begins at position 150 of its parental molecule, one must add 150−1, i.e., 149 to each HLA peptide amino acid position to calculate the position of that amino acid in the parent molecule.

One embodiment of the invention comprises an HLA peptide, that occurs at least twice in Tables VIII-XXI and XXII to XLIX collectively, or an oligonucleotide that encodes the HLA peptide. Another embodiment of the invention comprises an HLA peptide that occurs at least once in Tables VIII-XXI and at least once in tables XXII to XLIX, or an oligonucleotide that encodes the HLA peptide.

Another embodiment of the invention is antibody epitopes, which comprise a peptide regions, or an oligonucleotide encoding the peptide region, that has one two, three, four, or five of the following characteristics:

i) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Hydrophilicity profile of FIG. 5;

ii) a peptide region of at least 5 amino acids of a particular peptide of FIG. 3, in any whole number increment up to the full length of that protein in FIG. 3, that includes an amino acid position having a value equal to or less than 0.5, 0.4, 0.3, 0.2, 0.1, or having a value equal to 0.0, in the Hydropathicity profile of FIG. 6;

iii) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Percent Accessible Residues profile of FIG. 7;

iv) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Average Flexibility profile of FIG. 8; or v) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Beta-turn profile of FIG. 9.[!!! The Figure descriptions need to be revise when using this as a template].

BRIEF DESCRIPTION OF THE FIGURES

FIG. 1. The 158P3D2 SSH sequence of 312 nucleotides.

Figures 2, 10:
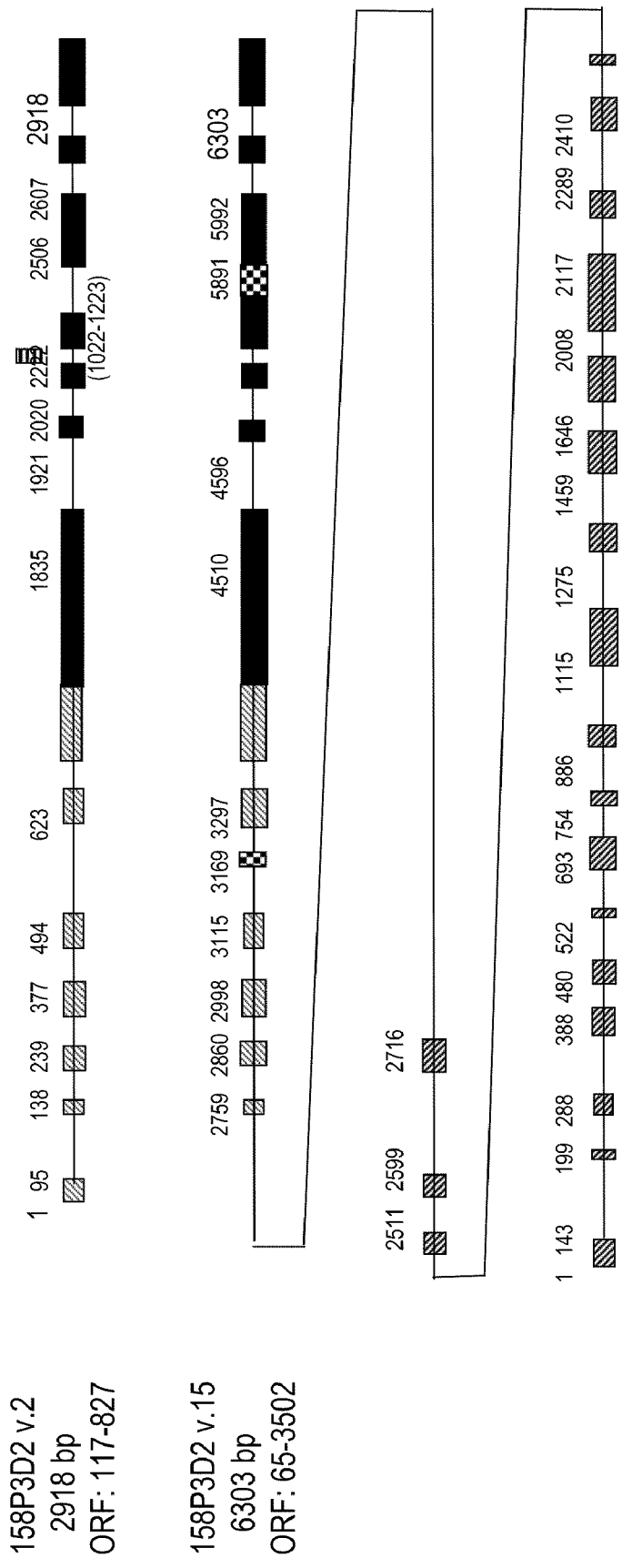
FIG. 2A) The cDNA and amino acid sequence of 158P3D2 variant 1 clone 158P3D2-BCP-1 (also called "158P3D2 v.1" or "158P3D2 variant 1") is shown in FIG. 2A. The start methionine is underlined. The open reading frame extends from nucleic acid 849-1835 including the stop codon.
FIG. 2B) The cDNA and amino acid sequence of 158P3D2 variant 2A (also called "158P3D2 v.2") is shown in FIG. 2B. The codon for the start methionine is underlined. The open reading frame extends from nucleic acid 117-827 including the stop codon.
FIG. 2C) The cDNA and amino acid sequence of 158P3D2 variant 2B (also called "158P3D2 v.2") is shown in FIG. 2C. The codon for the start methionine is underlined. The open reading frame extends from nucleic acid 2249-2794 including the stop codon.
FIG. 2D) The cDNA and amino acid sequence of 158P3D2 variant 3 (also called "158P3D2 v.3") is shown in FIG. 2D. The codon for the start methionine is underlined. The open reading frame extends from nucleic acid 849-1835 including the stop codon.
FIG. 2E) The cDNA and amino acid sequence of 158P3D2 variant 4 (also called "158P3D2 v.4") is shown in FIG. 2E. The codon for the start methionine is underlined. The open reading frame extends from nucleic acid 849-1835 including the stop codon.
FIG. 2F) The cDNA and amino acid sequence of 158P3D2 variant 5A (also called "158P3D2 v.5") is shown in FIG. 2F. The codon for the start methionine is underlined. The open reading frame extends from nucleic acid 849-1385 including the stop codon.
FIG. 2G) The cDNA and amino acid sequence of 158P3D2 variant 5B (also called "158P3D2 v.5") is shown in FIG. 2G. The codon for the start methionine is underlined. The open reading frame extends from nucleic acid 1289-1834 including the stop codon.
FIG. 2H) The cDNA and amino acid sequence of 158P3D2 variant 6 (also called "158P3D2 v.6") is shown in FIG. 2H. The codon for the start methionine is underlined. The open reading frame extends from nucleic acid 849-1835 including the stop codon.
FIG. 2I) The cDNA and amino acid sequence of 158P3D2 variant 7 (also called "158P3D2 v.7") is shown in FIG. 2I. The codon for the start methionine is underlined. The open reading frame extends from nucleic acid 849-1835 including the stop codon.
FIG. 2J) The cDNA and amino acid sequence of 158P3D2 variant 8 (also called "158P3D2 v.8") is shown in FIG. 2J. The codon for the start methionine is underlined. The open reading frame extends from nucleic acid 849-1835 including the stop codon.
FIG. 2K) The cDNA and amino acid sequence of 158P3D2 variant 14 (also called "158P3D2 v.14") is shown in FIG. 2K. The codon for the start methionine is underlined. The open reading frame extends from nucleic acid 65-4246 including the stop codon.
FIG. 2L) The cDNA and amino acid sequence of 158P3D2 variant 15 (also called "158P3D2 v.15") is shown in FIG. 2L. The codon for the start methionine is underlined. The open reading frame extends from nucleic acid 65-3502 including the stop codon.
FIG. 2M) The cDNA and amino acid sequence of 158P3D2 variant 16 (also called "158P3D2 v.16") is shown in FIG. 2M. The codon for the start methionine is underlined. The open reading frame extends from nucleic acid 65-6037 including the stop codon.
FIG. 2N) The cDNA and amino acid sequence of 158P3D2 variant 17 (also called "158P3D2 v.17") is shown in FIG. 2N. The codon for the start methionine is underlined. The open reading frame extends from nucleic acid 65-6175 including the stop codon.
FIG. 2O) The cDNA and amino acid sequence of 158P3D2 variant 18 (also called "158P3D2 v.18") is shown in FIG. 2O. The codon for the start methionine is underlined. The open reading frame extends from nucleic acid 2932-4764 including the stop codon.
FIG. 2P) The cDNA and amino acid sequence of 158P3D2 variant 19 (also called "158P3D2 v.19") is shown in FIG. 2P. The codon for the start methionine is underlined. The open reading frame extends from nucleic acid 65-6001 including the stop codon.
FIG. 2Q) The cDNA and amino acid sequence of 158P3D2 variant 20 (also called "158P3D2 v.20") is shown in FIG. 2Q. The codon for the start methionine is underlined. The open reading frame extends from nucleic acid 65-6121 including the stop codon.
FIG. 2R) 158P3D2 v.9 through v.13, SNP variants of 158P3D2 v.1. The 158P3D2 v.9 through v.13 proteins have 1072 amino acids. Variants 158P3D2 v.4 through v.20 are variants with single nucleotide difference from 158P3D2 v.1.

158P3D2 v.10, v.12 and v.13 proteins differ from 158P3D2 v.1 by one amino acid. 158P3D2 v.9 and v.11 proteins code for the same protein as v.1. Though these SNP variants are shown separately, they can also occur in any combinations and in any of the transcript variants listed above in FIGS. 2A-2Q.

FIG. 3A) The amino acid sequence of 158P3D2 v.1 clone 158P3D2-BCP-1 is shown in FIG. 3A; it has 328 amino acids.

FIG. 3B) The amino acid sequence of 158P3D2 v.2A is shown in FIG. 3B; it has 236 amino acids.

FIG. 3C) The amino acid sequence of 158P3D2 v.2B is shown in FIG. 3C; it has 181 amino acids.

FIG. 3D) The amino acid sequence of 158P3D2 v.3 is shown in FIG. 3D; it has 328 amino acids.

FIG. 3E) The amino acid sequence of 158P3D2 v.4 is shown in FIG. 3E; it has 328 amino acids.

FIG. 3F) The amino acid sequence of 158P3D2 v.5A is shown in FIG. 3F; it has 178 amino acids.

FIG. 3G) The amino acid sequence of 158P3D2 v.5B is shown in FIG. 3G; it has 181 amino acids.

FIG. 3H) The amino acid sequence of 158P3D2 v.10 is shown in FIG. 3H; it has 328 amino acids.

FIG. 3I) The amino acid sequence of 158P3D2 v.11 is shown in FIG. 3I; it has 328 amino acids.

FIG. 3J) The amino acid sequence of 158P3D2 v.12 is shown in FIG. 3J; it has 328 amino acids.

FIG. 3K) The amino acid sequence of 158P3D2 v.13 is shown in FIG. 3K; it has 328 amino acids.

FIG. 3L) The amino acid sequence of 158P3D2 v.14 is shown in FIG. 3L; it has 1393 amino acids.

FIG. 3M) The amino acid sequence of 158P3D2 v.15 is shown in FIG. 3M; it has 1145 amino acids.

FIG. 3N) The amino acid sequence of 158P3D2 v.16 is shown in FIG. 3N; it has 1990 amino acids.

FIG. 3O) The amino acid sequence of 158P3D2 v.17 is shown in FIG. 3O; it has 2036 amino acids.

FIG. 3P) The amino acid sequence of 158P3D2 v.18 is shown in FIG. 3P; it has 610 amino acids.

FIG. 3Q) The amino acid sequence of 158P3D2 v.19 is shown in FIG. 3Q; it has 1978 amino acids.

FIG. 3R) The amino acid sequence of 158P3D2 v.20 is shown in FIG. 3R; it has 2018 amino acids.

As used herein, a reference to 158P3D2 includes all variants thereof, including those shown in FIGS. 2, 3, 10, 11, and 12 unless the context clearly indicates otherwise.

Figures 3, 10:
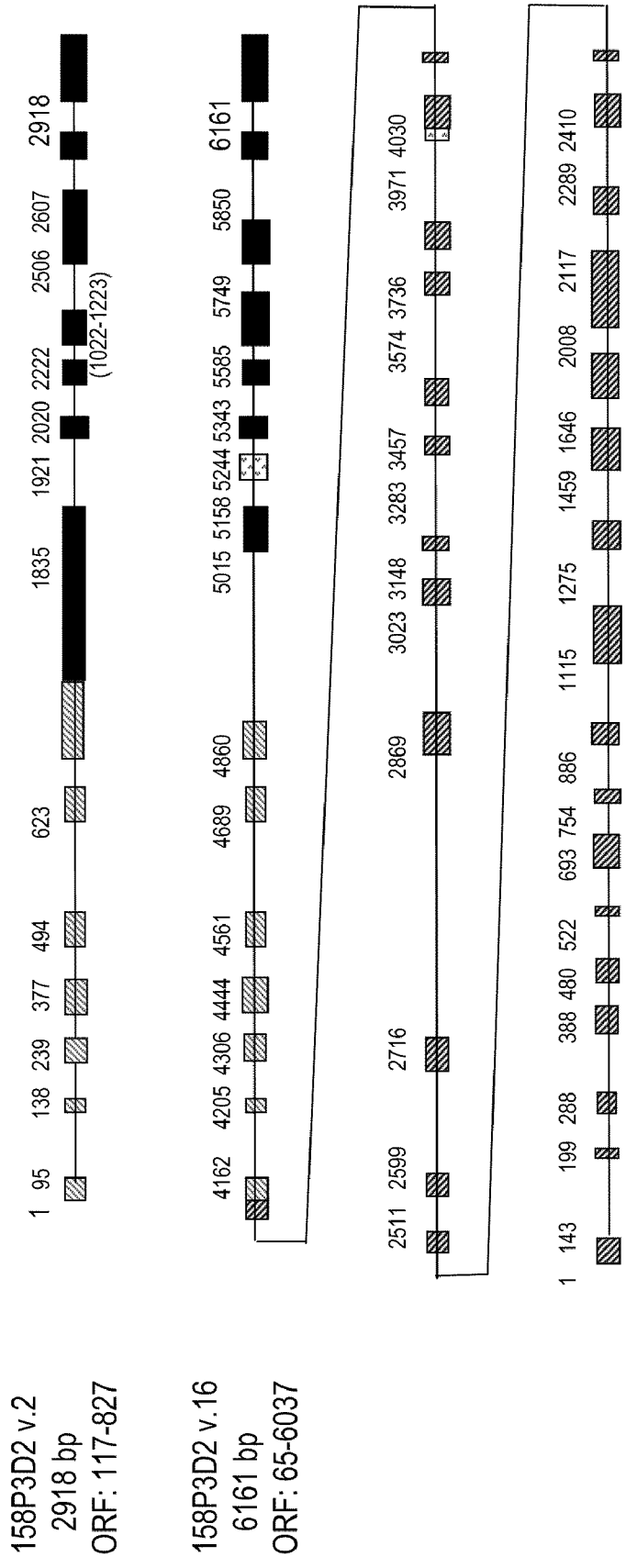
Figures 4, 10:

FIG. 4. Effect of 158P3D2 RNAi on cell proliferation. SCaBER cells or Cos-1 cells were transfected with Lipofectamine 2000 reagent (LF2K) alone, or with negative control Luc4 oligo (20 nM), positive control Eg5 oligo (20 nM) or 158P3D2.b oligo (20 nM). After 48 hours, the media was replaced and the cells were incubated for 24 hrs, pulsed with $^3$H-thymidine at 1.5 µCi/ml for 14 hrs, harvested onto a filtermat and counted in scintillation cocktail on a Microbeta trilux counter. Percentage cell proliferation relative to the LF2k control (100%) is shown. The reduction in 158P3D2 levels by the 158P3D2.b siRNA oligo correlated with diminished cell proliferation in the SCaBER cells, but no effect was observed in the 158P3D2-negative cell line Cos-1.

FIG. 5(a)-(i). Hydrophilicity amino acid profile of 158P3D2 v.1, v.2a, v.2b, v.5a, v.14, v.15, v.16, v.17, and v.18 determined by computer algorithm sequence analysis using the method of Hopp and Woods (Hopp T. P., Woods K. R., 1981. Proc. Natl. Acad. Sci. U.S.A. 78:3824-3828) accessed on the Protscale website located on the World Wide Web at (expasy.ch/cgi-bin/protscale.pl) through the ExPasy molecular biology server.

FIG. 6(a)-(i). Hydropathicity amino acid profile of 158P3D2 v.1, v.2a, v.2b, v.5a, v.14, v.15, v.16, v.17, and v.18 determined by computer algorithm sequence analysis using the method of Kyte and Doolittle (Kyte J., Doolittle R. F., 1982. J. Mol. Biol. 157:105-132) accessed on the ProtScale website located on the World Wide Web at (.expasy.ch/cgi-bin/protscale.pl) through the ExPasy molecular biology server.

FIG. 7(a)-(i). Percent accessible residues amino acid profile of 158P3D2 v.1, v.2a, v.2b, v.5a, v.14, v.15, v.16, v.17, and v.18 determined by computer algorithm sequence analysis using the method of Janin (Janin J., 1979 Nature 277:491-492) accessed on the ProtScale website located on the World Wide Web at (.expasy.ch/cgi-bin/protscale.pl) through the ExPasy molecular biology server.

FIG. 8(a)-(i). Average flexibility amino acid profile of 158P3D2 v.1, v.2a, v.2b, v.5a, v.14, v.15, v.16, v.17, and v.18 determined by computer algorithm sequence analysis using the method of Bhaskaran and Ponnuswamy (Bhaskaran R., and Ponnuswamy P. K., 1988. Int. J. Pept. Protein Res. 32:242-255) accessed on the ProtScale website located on the World Wide Web at (.expasy.ch/cgi-bin/protscale.pl) through the ExPasy molecular biology server.

FIG. 9(a)-(i). Beta-turn amino acid profile of 158P3D2 v.1, v.2a, v.2b, v.5a, v.14, v.15, v.16, v.17, and v.18 determined by computer algorithm sequence analysis using the method of Deleage and Roux (Deleage, G., Roux B. 1987 Protein Engineering 1:289-294) accessed on the ProtScale website located on the World Wide Web at (.expasy.ch/cgi-bin/protscale.pl) through the ExPasy molecular biology server.

FIG. 10. Exon compositions of transcript variants of 158P3D2. Variant 158P3D2 v.2, v.14 through v.20 are transcript variants. Compared with 158P3D2 v.1; v.2 had six additional exons to the 5' end, an exon 7 longer than exon 1 of 158P3D2 v.1 and an exon 10 shorter than exon 4 of 158P3D2 v.1. Exons 2, 3, 5, 6 and 7 of 158P3D2 v.1 are the same as exons 8, 9, 11, 12 and 13 of 158P3D2 v.2, respectively. Other variants had different exon compositions as shown above. Numbers in "( )" underneath the box correspond to those of 158P3D2 v.1. Black boxes show the same sequence as 158P3D2 v.1. Length of introns are not proportional.

Figure 11:
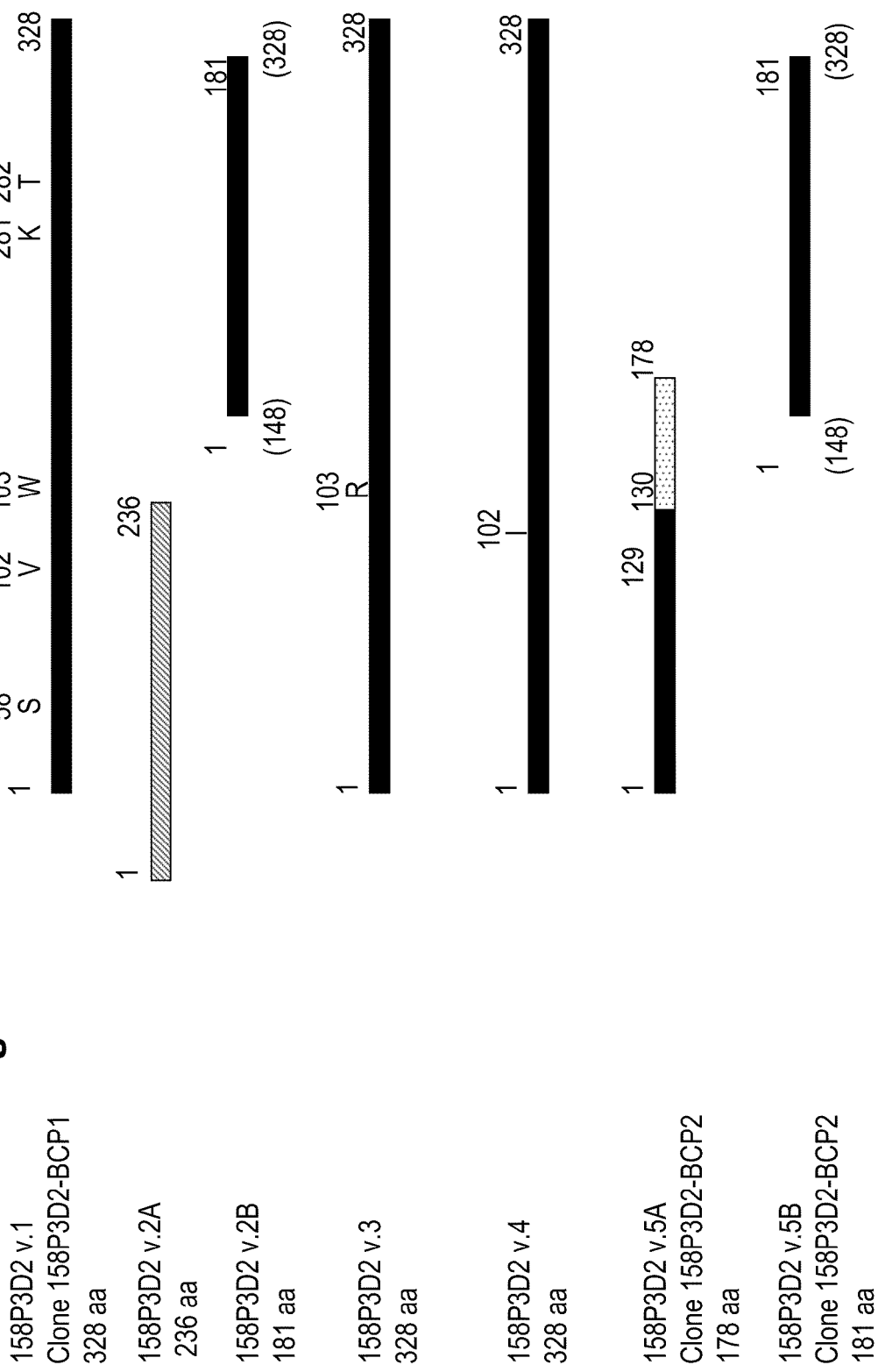
Figures 2, 11:
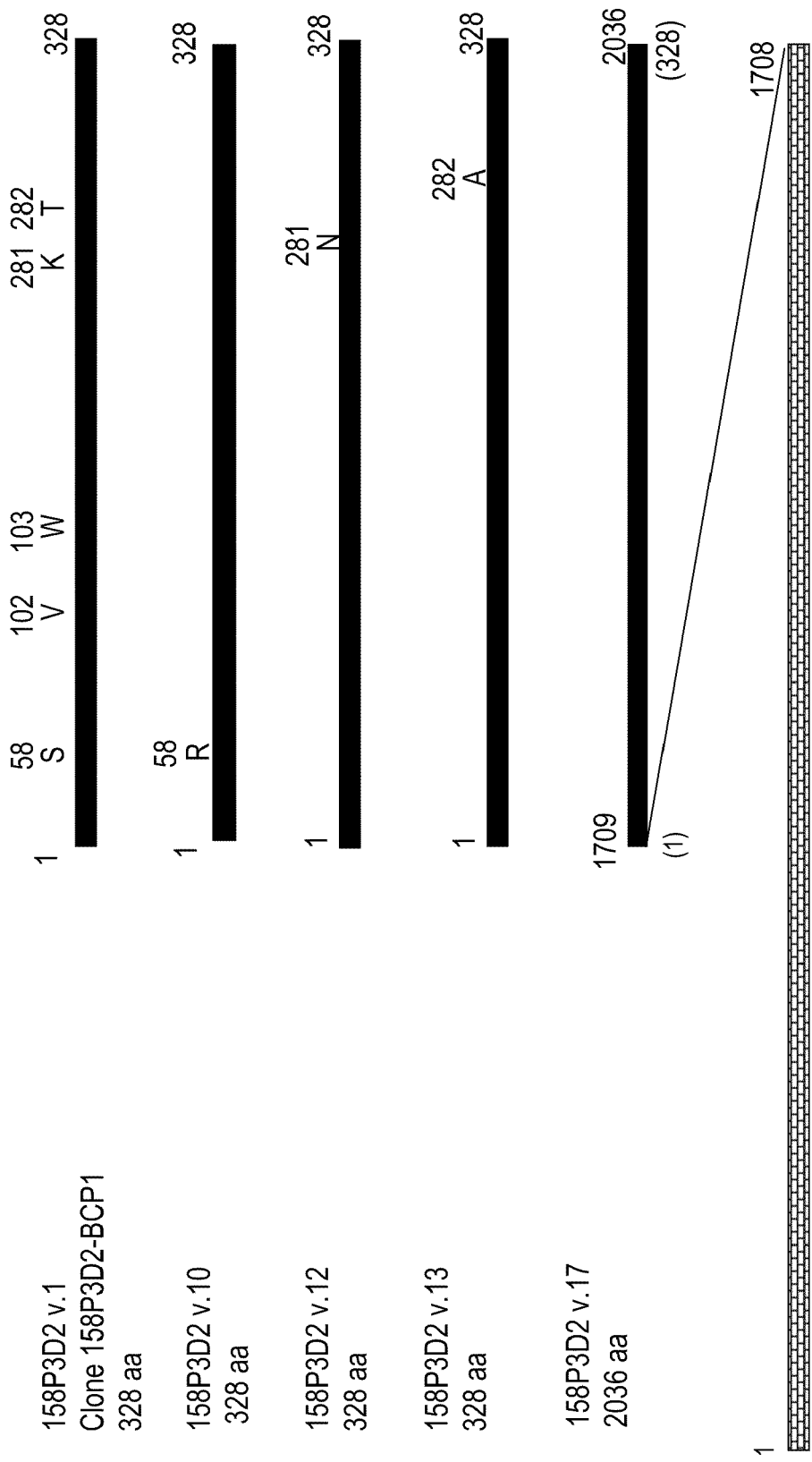
Figures 3, 11:
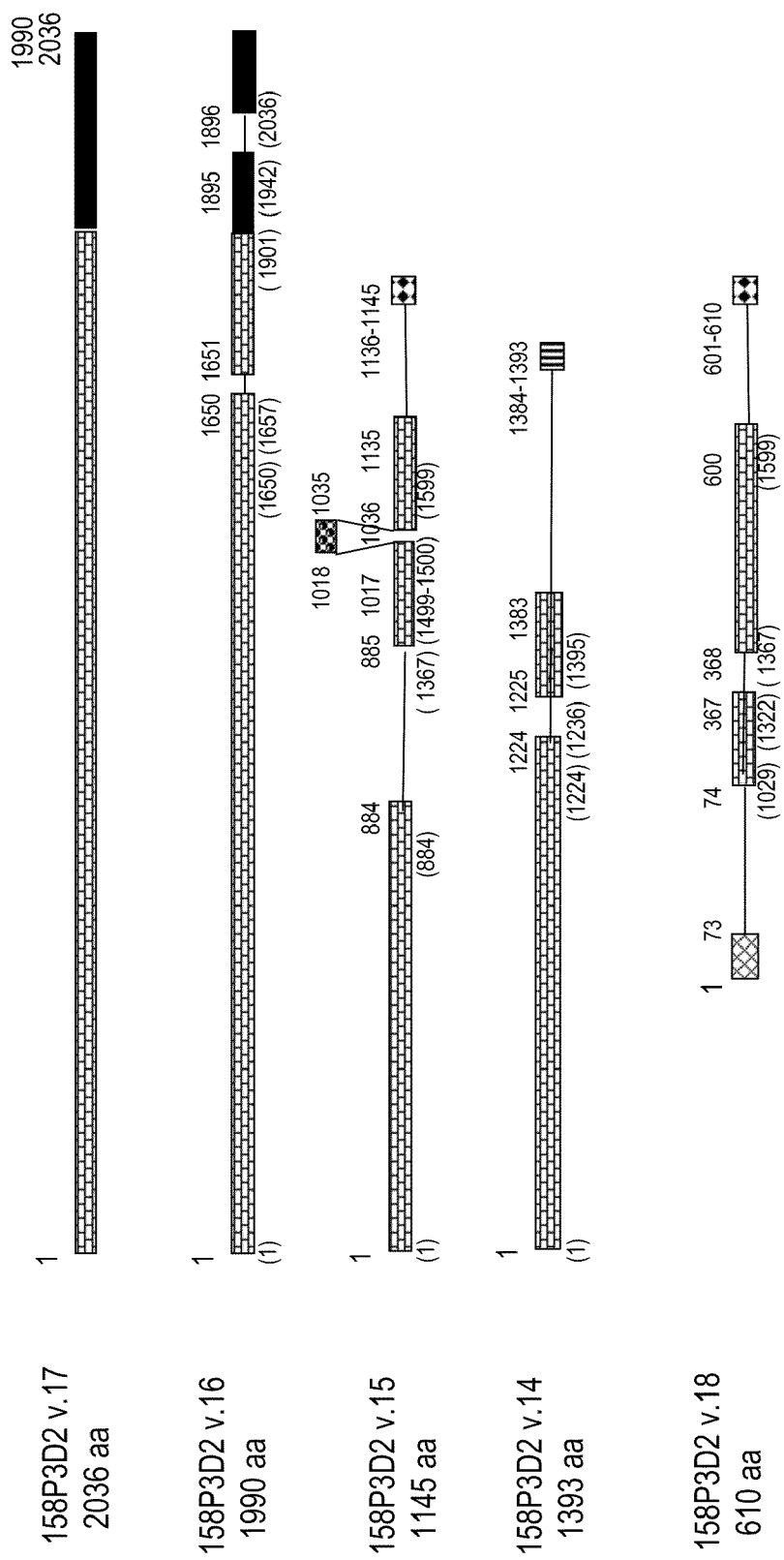
Figures 4, 11:
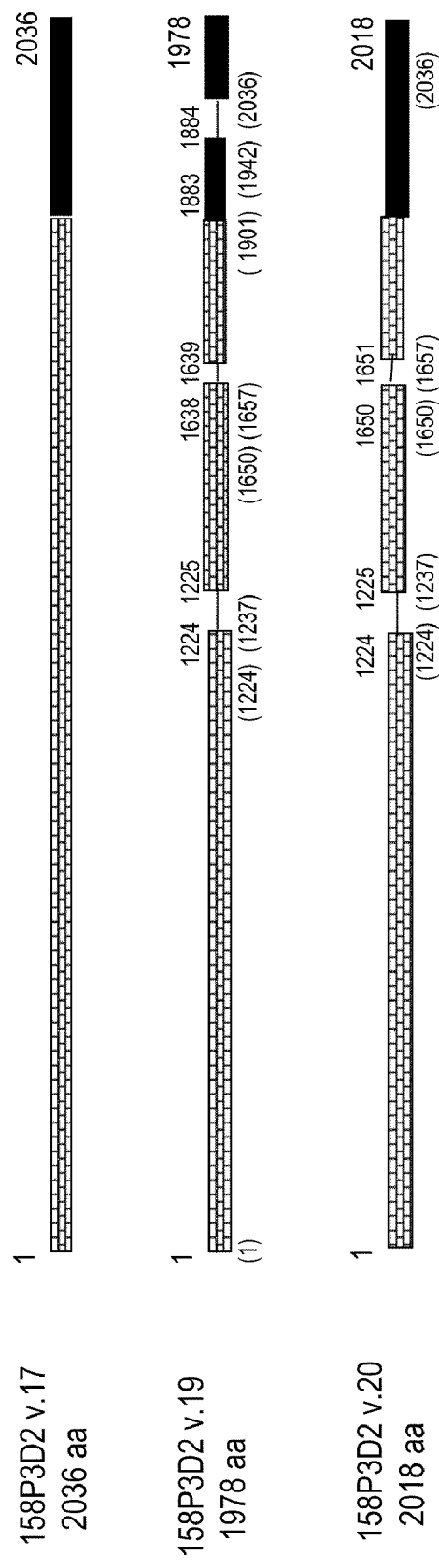

FIG. 11. Schematic display of protein variants of 158P3D2. Nucleotide variant 158P3D2 v.2 and 158P3D2 v.5 potentially coded for two different proteins, designated as variants 158P3D2 v.2A and 158P3D2 v.2B, 158P3D2 v.5A and 158P3D2 v.5B, respectively. Variant 158P3D2 v.5B shares the same amino acid sequence as variant 158P3D2 v.2B. Variants 158P3D2 v.3 and v.4 were variants with single amino acid variations. Black box shows the same sequence as 158P3D2 v.1. Numbers in "( )" underneath the black boxes correspond to those of 158P3D2 v.1 and those underneath the "brick" boxes correspond to those of v.17. Single amino acid differences are indicated above the box.

Figure 12:
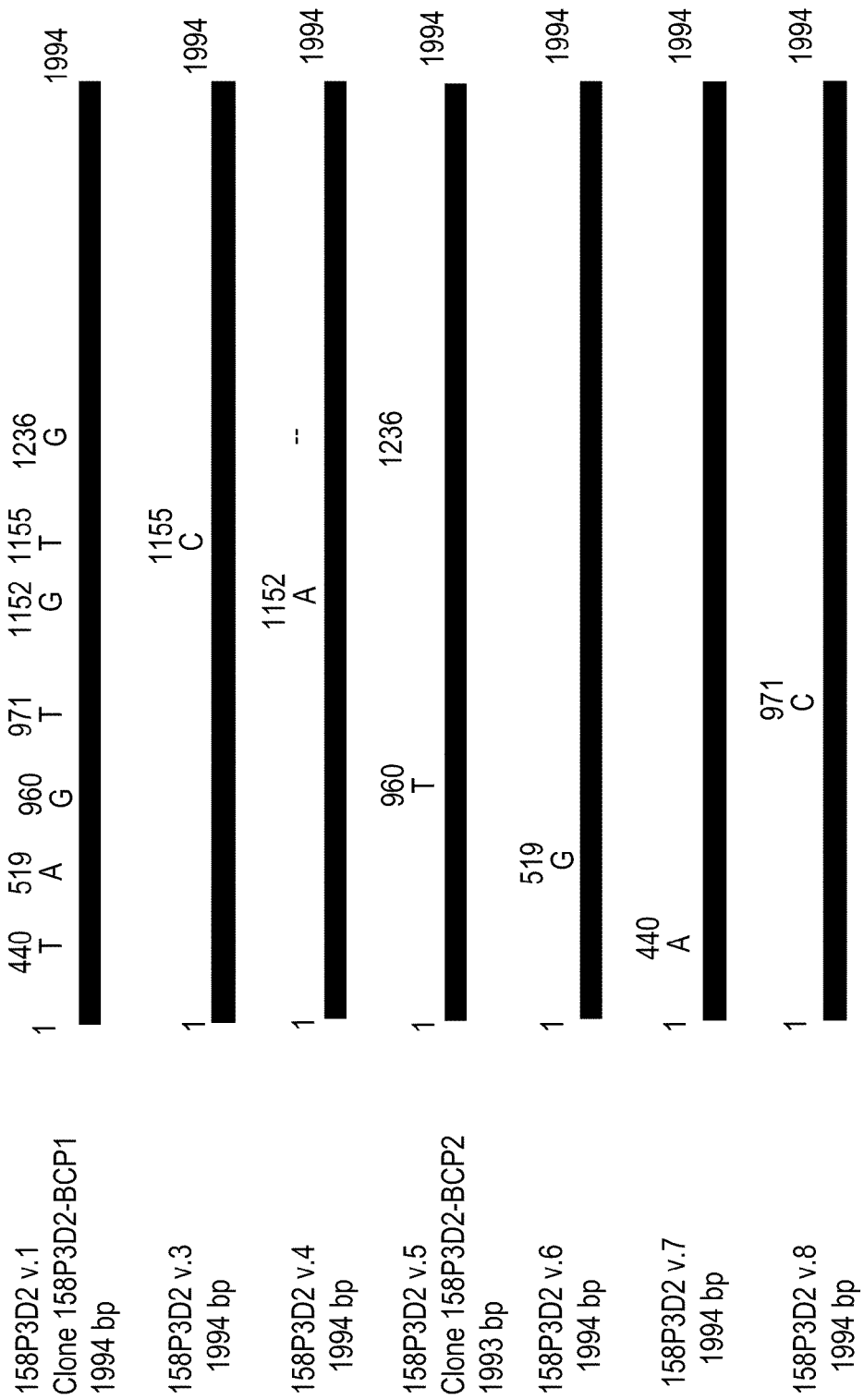
Figures 2, 12:
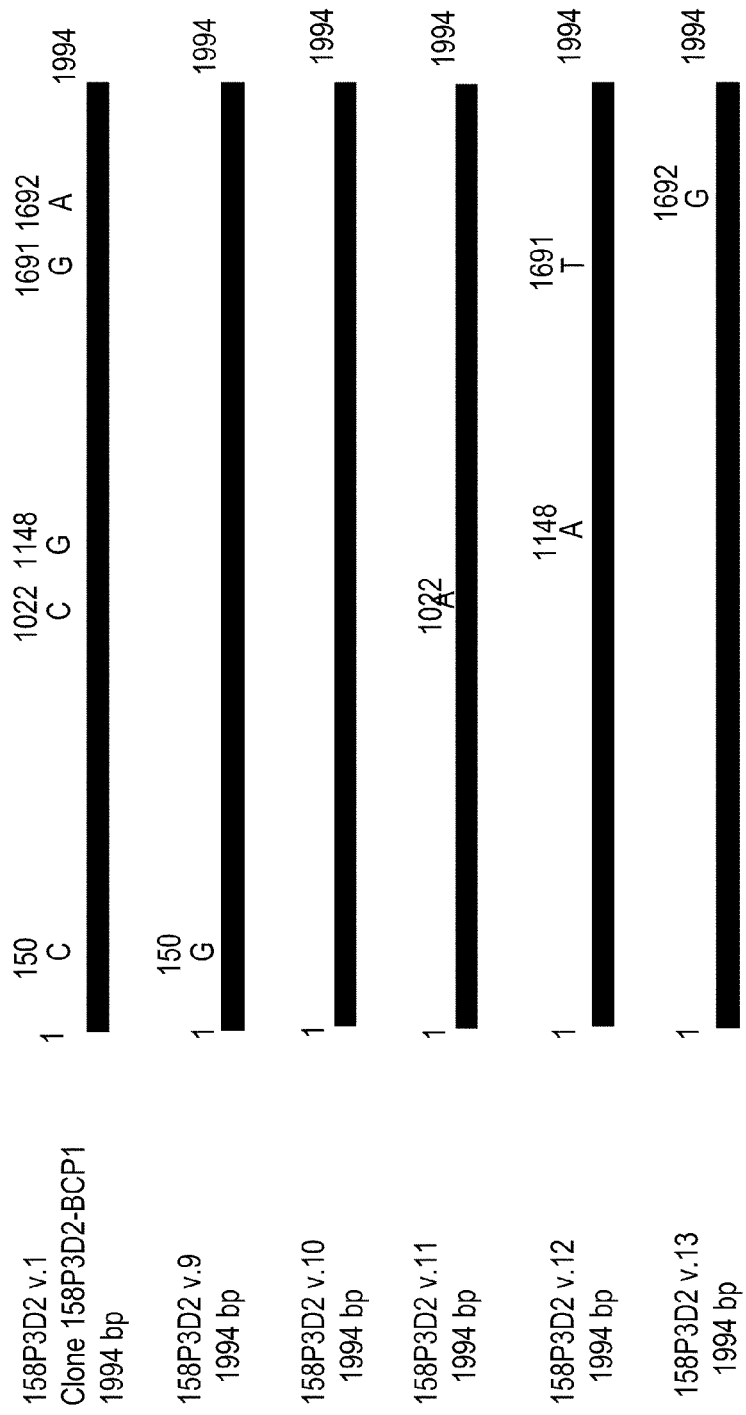

FIG. 12. Schematic display of SNP variants of 158P3D2. Variant 158P3D2 v.3 through v.13 are variants with a single nucleotide difference from v.1. Though these alternative SNP alleles were shown separately, they could occur in any transcript variants in any combination (called haplotype). Numbers in "( )" underneath the box correspond to those of 158P3D2 v.1. '-' indicate single nucleotide deletion. Black boxes show the same sequence as 158P3D2 v.1. SNPs are indicated above the box.

Figure 13X:
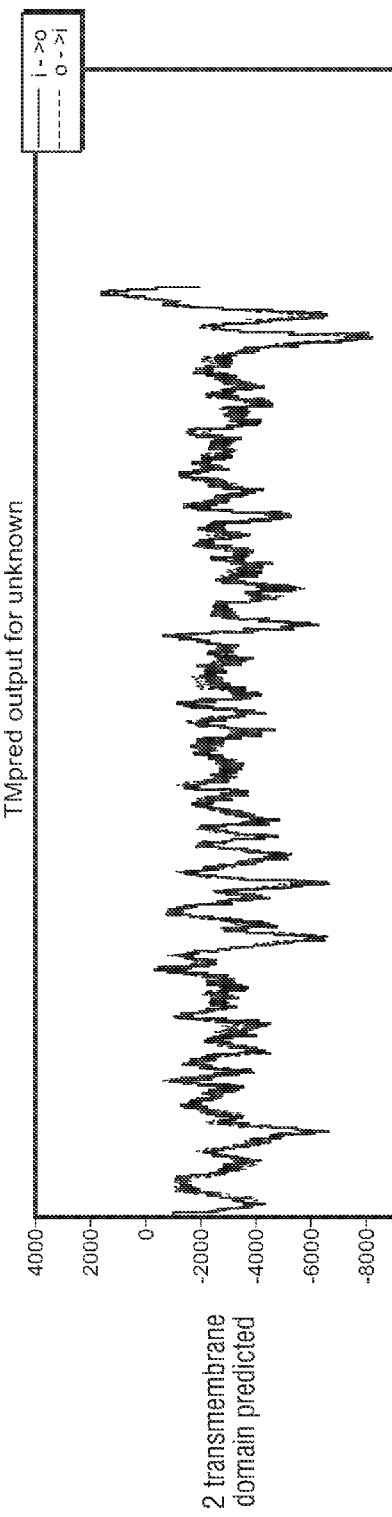
Figure 13Y:
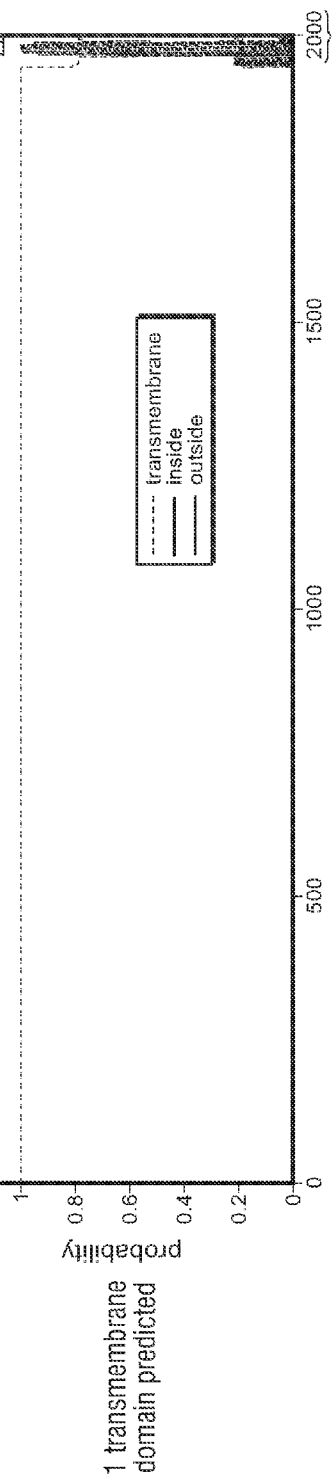

FIG. 13. Secondary structure and transmembrane domains prediction for 158P3D2 protein variants.

FIG. 13A (SEQ ID NO: 54), FIG. 13B (SEQ ID NO: 55), FIG. 13C (SEQ ID NO: 56), FIG. 13D (SEQ ID NO: 57), FIG. 13E (SEQ ID NO: 58), FIG. 13F (SEQ ID NO: 59), FIG. 13G (SEQ ID NO: 60), FIG. 13H (SEQ ID NO: 61), FIG. 13I (SEQ ID NO: 62): The secondary structures of 158P3D2 protein variants 1, 2a, 2b, 5a, 14, 15, 16, 17, 18 respectively, were predicted using the HNN—Hierarchical Neural Network method (NPS@: Network Protein Sequence Analysis TIBS 2000 March Vol. 25, No 3 [291]:147-150 Combet C., Blanchet C., Geourjon C. and Deléage G., accessed from the ExPasy molecular biology server. This method predicts the presence and location of alpha helices, extended strands, and random coils from the primary protein sequence. The percent of the protein variant in a given secondary structure is also listed.

FIG. 13J, FIG. 13L, FIG. 13N, FIG. 13P, FIG. 13R, FIG. 13T, FIG. 13V, FIG. 13X, and FIG. 13Z: Schematic representation of the probability of existence of transmembrane regions of 158P3D2 protein variants 1, 2a, 2b, 5a, 14, 15, 16, 17, 18 respectively, based on the TMpred algorithm of Hofmann and Stoffel which utilizes TMBASE (K. Hofmann, W. Stoffel. TMBASE-A database of membrane spanning protein segments Biol. Chem. Hoppe-Seyler 374:166, 1993). FIG. 13K, FIG. 13M, FIG. 13O, FIG. 13Q, FIG. 13S, FIG. 13U, FIG. 13W, FIG. 13Y, FIG. 13AA: Schematic representation of the probability of the existence of transmembrane regions of 158P3D2 variants 1, 2a, 2b, 5a, 14, 15, 16, 17, 18 respectively, based on the TMHMM algorithm of Sonnhammer, von Heijne, and Krogh (Erik L. L. Sonnhammer, Gunnar von Heijne, and Anders Krogh: A hidden Markov model for predicting transmembrane helices in protein sequences. In Proc. of Sixth Int. Conf. on Intelligent Systems for Molecular Biology, p 175-182 Ed J. Glasgow, T. Littlejohn, F. Major, R. Lathrop, D. Sankoff, and C. Sensen Menlo Park, Calif.: AAAI Press, 1998). The TMpred and TMHMM algorithms are accessed from the ExPasy molecular biology server.

FIG. 14. 158P3D2 Expression in Normal and Cancer Tissue Specimens. First strand cDNA was prepared from a panel of 13 normal tissues (brain, heart, kidney, liver, lung, spleen, skeletal muscle, testis, pancreas, colon, stomach) and pools of 4-7 patients from the following cancer indications: bladder, kidney, colon, lung, pancreas, stomach, ovary, breast, multiple cancer metastasis, cervix, lymphoma as well as from a pool of patient-derived xenografts (prostate cancer, bladder cancer and kidney cancer). Normalization was performed by PCR using primers to actin and GAPDH. Semi-quantitative PCR, using primers to 158P3D2, was performed at 26 and 30 cycles of amplification. Samples were run on an agarose gel, and PCR products were quantitated using the AlphaImager software. Results show strong expression of 158P3D2 in cancers of the bladder, kidney, colon, lung, pancreas, stomach, ovary, breast, cervix, and lymphoma. Low expression was detected in all normal tissues tested except in normal stomach. Strong expression was also observed in the cancer metastasis pool.

Figure 15:
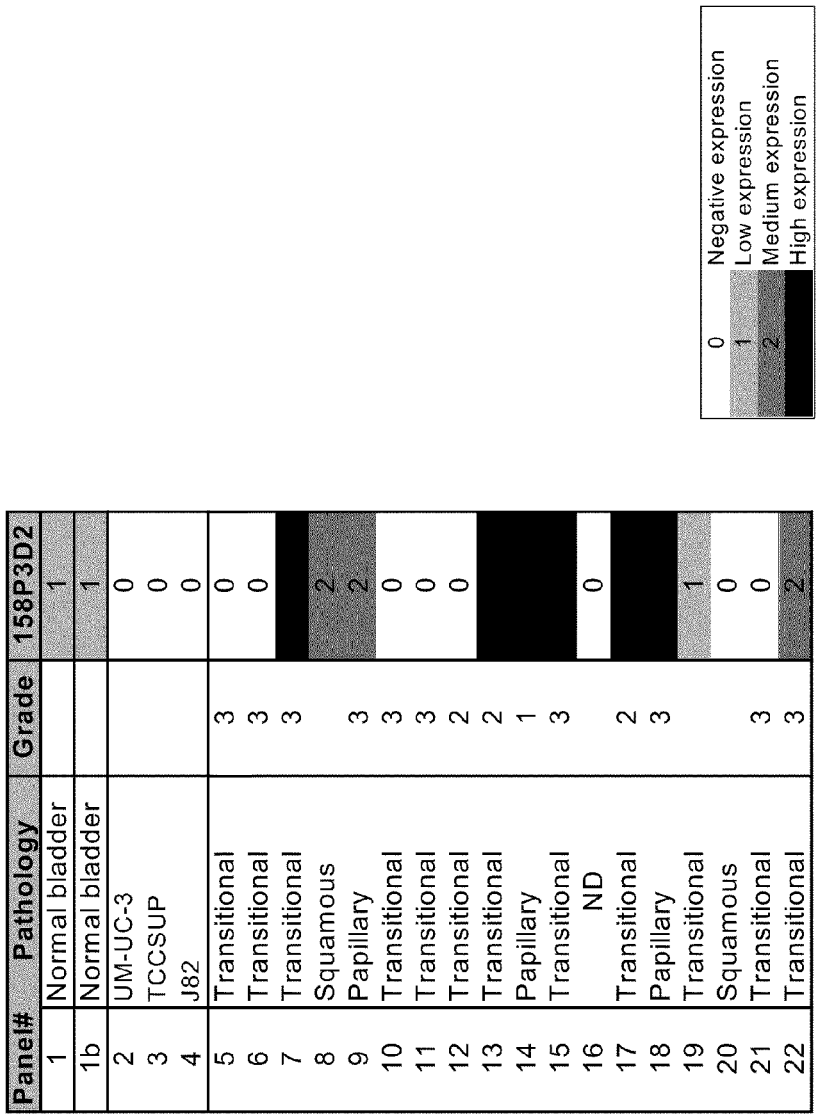

FIG. 15. 158P3D2 Expression in bladder cancer patient specimens. First strand cDNA was prepared from normal bladder, bladder cancer cell lines (UM-UC-3, TCCSUP, J82) and a panel of bladder cancer patient specimens. Normalization was performed by PCR using primers to actin and GAPDH. Expression level was recorded as no expression (no signal detected), low (signal detected at 30×), medium (signal detected at 26×), high (strong signal at 26×). Results show expression of 158P3D2 in the majority of bladder cancer patient specimens tested. Very low expression was detected in normal tissues, but no expression was seen in the cell lines tested.

Figure 16:
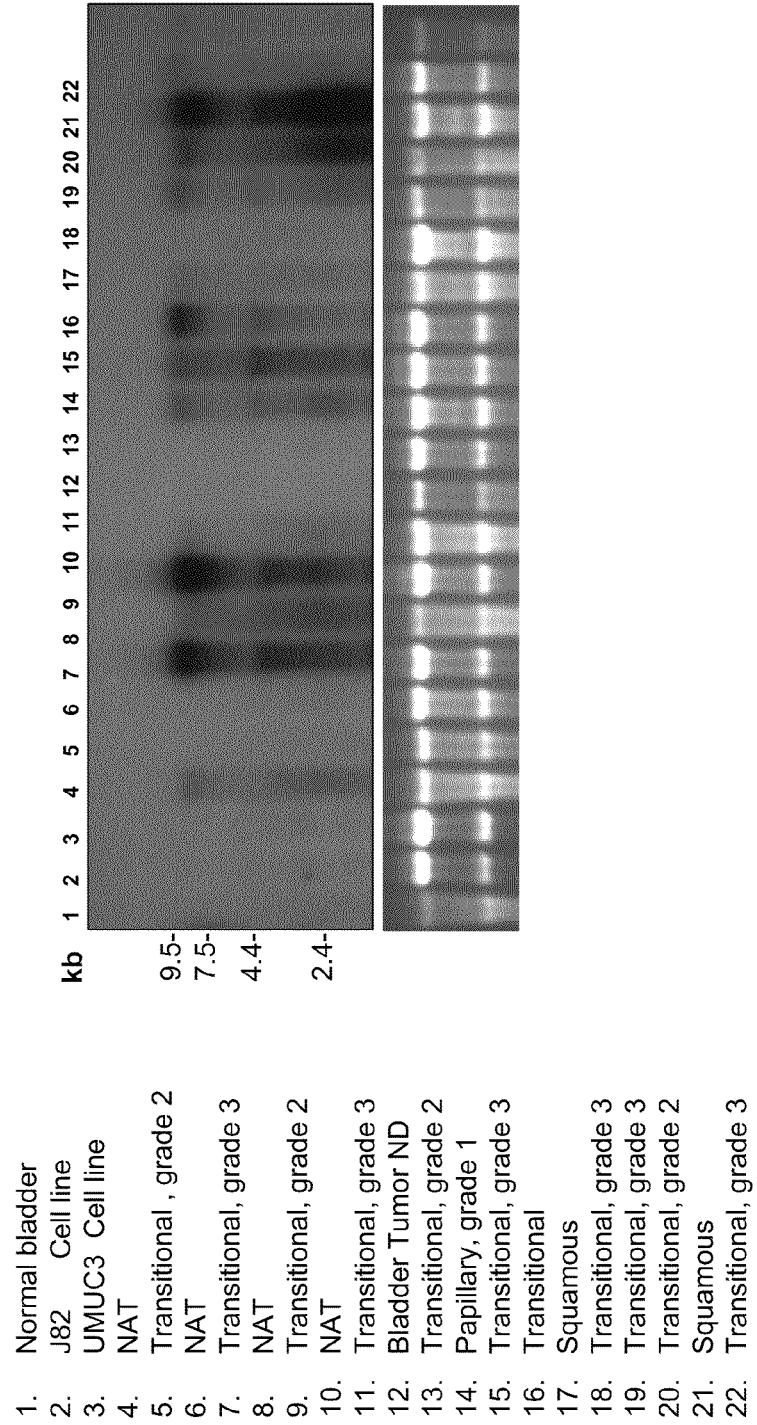

FIG. 16. 158P3D2 Expression in bladder cancer patient specimens by northern blotting. RNA was extracted from normal bladder, bladder cancer cell lines (UM-UC-3, J82, SCaBER), bladder cancer patient tumors (T) and their normal adjacent tissues (NAT). Northern blot with 10 ug of total RNA were probed with the 158P3D2 sequence. Size standards in kilobases are on the side. Results show strong expression of 158P3D2 in tumor tissues, but not in normal nor NAT tissues.

Figure 17:
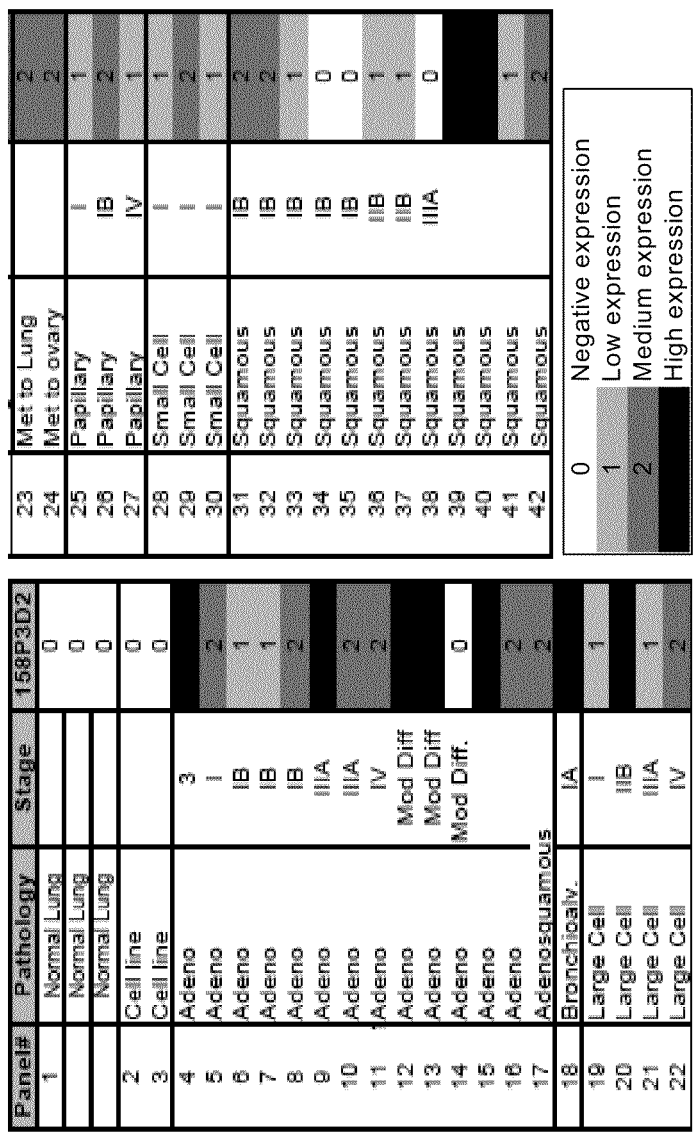

FIG. 17. 158P3D2 Expression in lung cancer patient specimens. First strand cDNA was prepared from normal lung, cancer cell line A427 and a panel of lung cancer patient specimens. Normalization was performed by PCR using primers to actin and GAPDH. Semi-quantitative PCR, using primers to 158P3D2, was performed at 26 and 30 cycles of amplification. Expression level was recorded as no expression (no signal detected), low (signal detected at 30×), medium (signal detected at 26×), high (strong signal at 26×). 158P3D2 is expressed at varying levels in $^{35}/_{39}$ (90%) of lung cancer specimens, but not in all 3 normal lung tissues tested.

FIG. 18. 158P3D2 Expression in lung cancer patient specimens by northern blotting. RNA was extracted from normal lung, A427 lung cancer cell line, and a panel of lung cancer patient specimens. Northern blot with 10 ug of total RNA were probed with the 158P3D2 sequence. Size standards in kilobases are on the side. Results show strong expression of 158P3D2 in tumor tissues but not in normal tissues.

Figure 19:
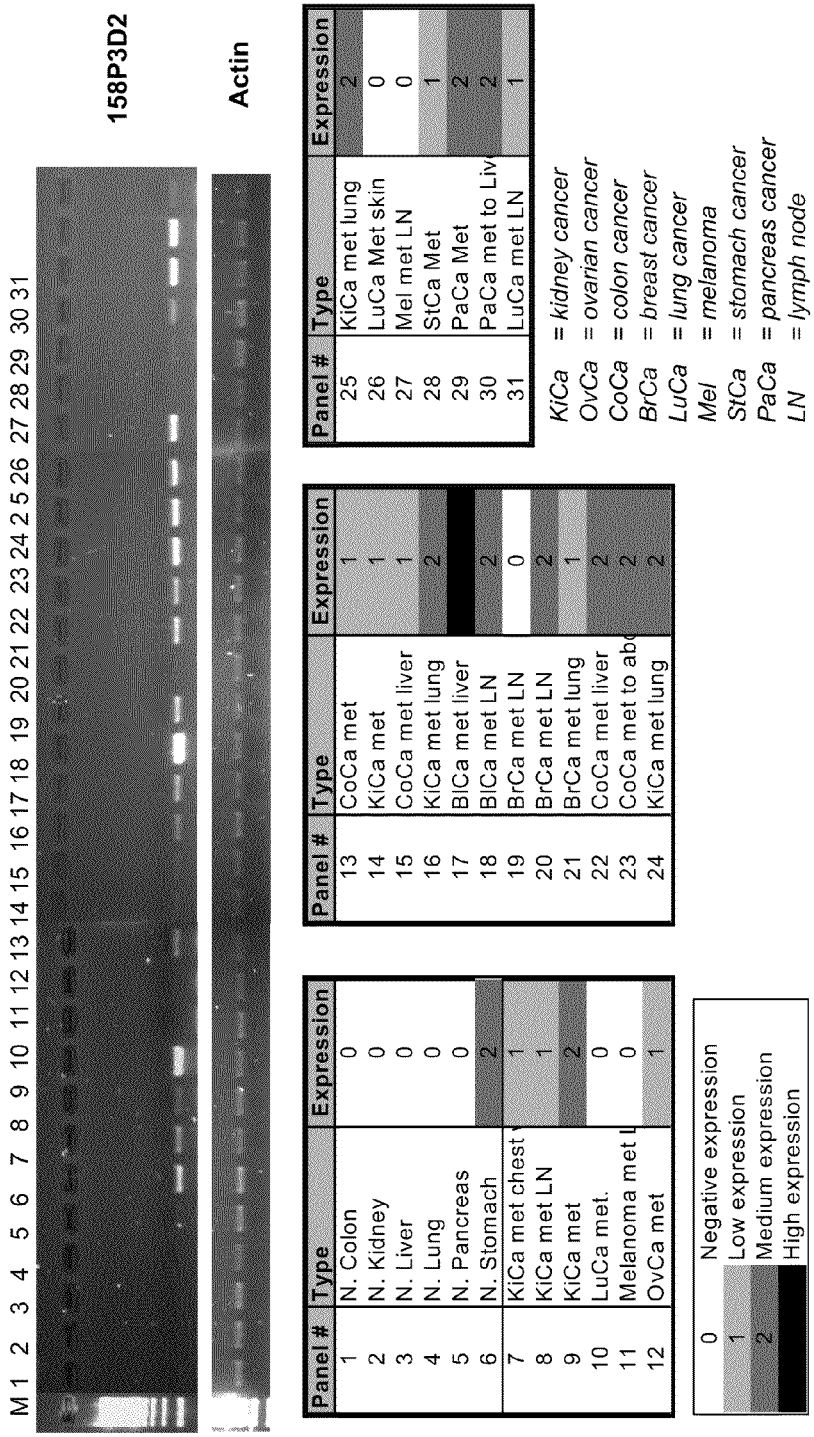

FIG. 19. 158P3D2 Expression in cancer metastasis patient specimens. First strand cDNA was prepared from normal colon, kidney, liver, lung, pancreas, stomach and from a panel of cancer metastasis patient specimens. Normalization was performed by PCR using primers to actin and GAPDH. Semi-quantitative PCR, using primers to 158P3D2, was performed at 26 and 30 cycles of amplification. Expression level was recorded as no expression (no signal detected), low (signal detected at 30×), medium (signal detected at 26×), high (strong signal at 26×). Results show expression of 158P3D2 in the majority of patient cancer metastasis specimens tested but not in normal tissues.

FIG. 20. 158P3D2 Expression in cervical cancer patient specimens. First strand cDNA was prepared from normal cervix, cervical cancer cell line HeLa, and a panel of cervical cancer patient specimens. Normalization was performed by PCR using primers to actin and GAPDH. Expression level was recorded as no expression (no signal detected), low (signal detected at 30×), medium (signal detected at 26×), high (strong signal at 26×). Results show expression of 158P3D2 in all 14 cervical cancer patient specimens tested. No expression was detected in normal cervix nor in the cell line tested.

FIG. 21. 158P3D2 Expression in cervical cancer patient specimens by northern blotting. RNA was extracted from normal cervix, cervical cancer cell line HeLa, and a panel of cervical cancer patient specimens. Northern blot with 10 ug of total RNA were probed with the 158P3D2 sequence. Size standards in kilobases are on the side. Results show strong expression of 158P3D2 in tumor tissues, but not in normal cervix nor in the cell line.

Figure 22:
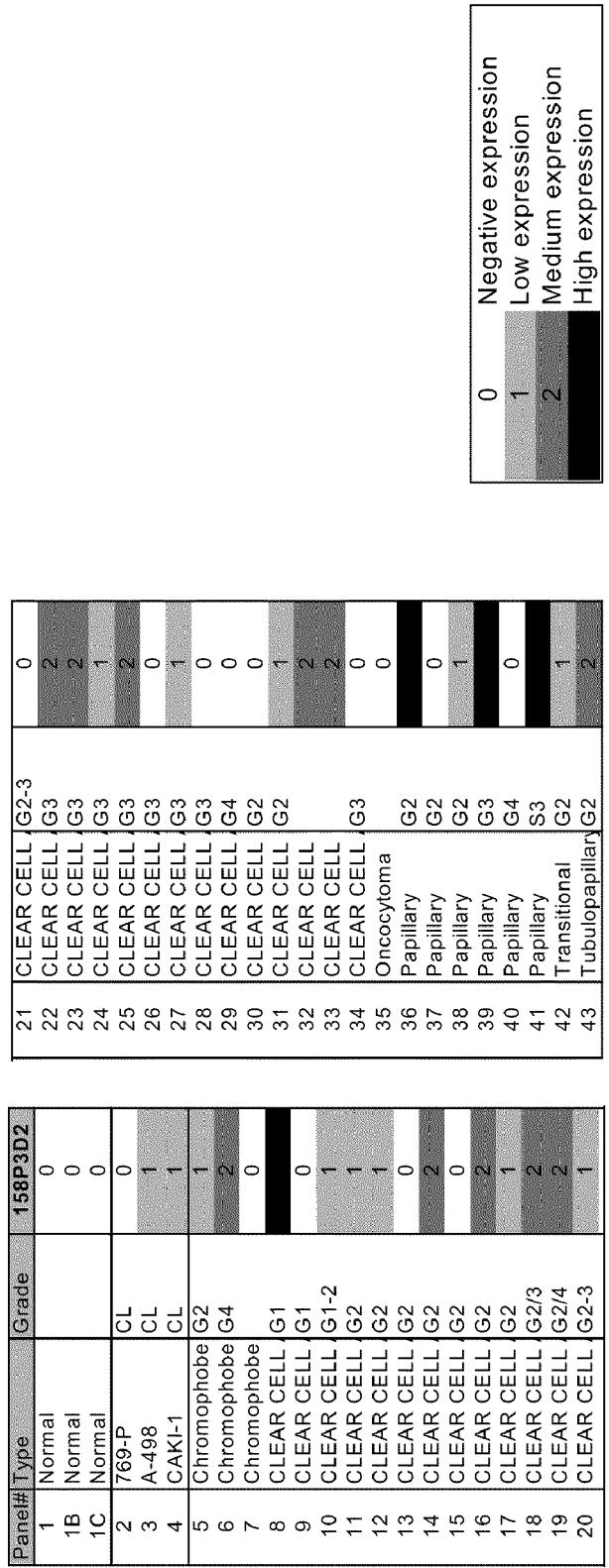

FIG. 22. 158P3D2 Expression in kidney cancer patient specimens. First strand cDNA was prepared from normal kidney, kidney cancer cell lines (769-P, A-498, CAKI-1), and a panel of kidney cancer patient specimens. Normalization was performed by PCR using primers to actin and GAPDH. Semi-quantitative PCR, using primers to 158P3D2, was performed at 26 and 30 cycles of amplification. Expression level was recorded as no expression (no signal detected), low (signal detected at 30×), medium (signal detected at 26×), high (strong signal at 26×). 158P3D2 is expressed at varying levels in the majority of kidney cancer patient specimens, but not in all 3 normal kidney tissues tested. Low expression was detected in 2 of 3 cell lines tested.

Figure 23:
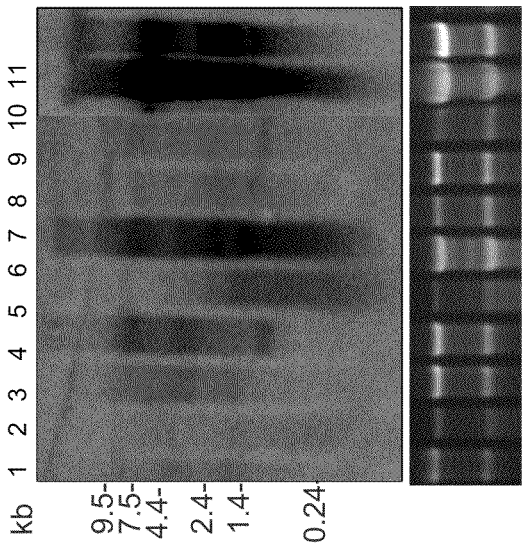

FIG. 23. 158P3D2 Expression in kidney cancer patient specimens by northern blotting. RNA was extracted from normal kidney and a panel of kidney cancer patient specimens. Northern blot with 10 ug of total RNA were probed with the 158P3D2 sequence. Size standards in kilobases are on the side. Results show strong expression of 158P3D2 in tumor specimens but not in the normal tissue.

Figure 24:
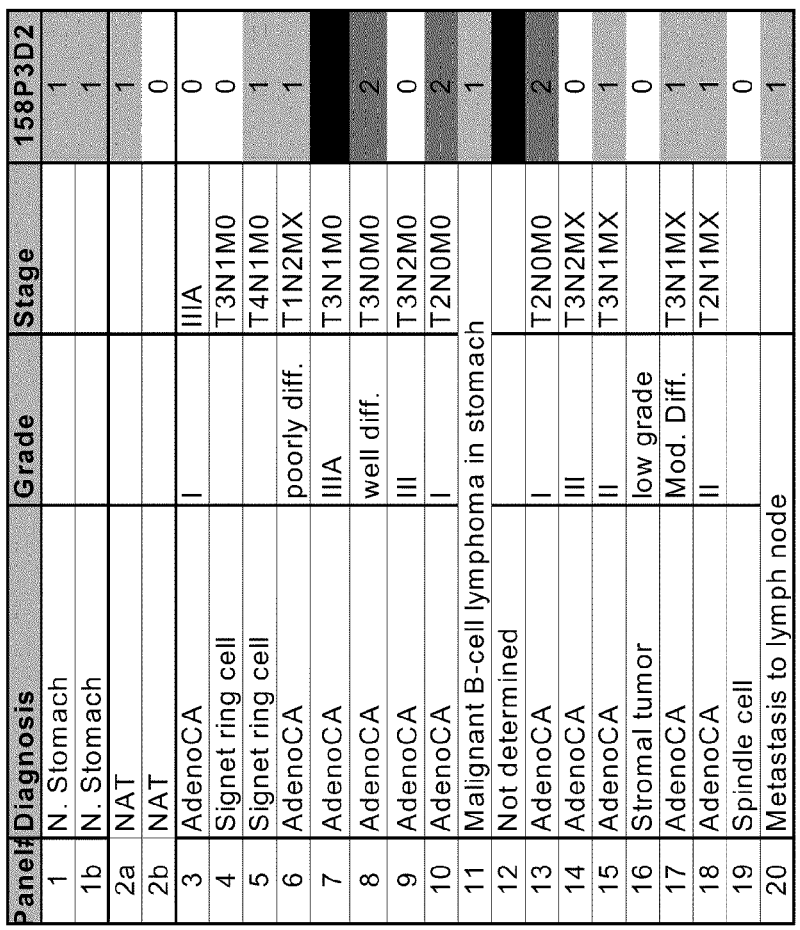

FIG. 24. 158P3D2 Expression in stomach cancer patient specimens. First strand cDNA was prepared from normal stomach, and a panel of stomach cancer patient specimens. Normalization was performed by PCR using primers to actin and GAPDH. Semi-quantitative PCR, using primers to 158P3D2, was performed at 26 and 30 cycles of amplification. Expression level was recorded as no expression (no signal detected), low (signal detected at 30x), medium (signal detected at 26x), high (strong signal at 26x). 158P3D2 is expressed at varying levels in the majority of stomach cancer patient specimens. Weak expression was detected in the 2 normal stomach, and only in 1 of the 2 NAT tissues tested.

Figure 25:
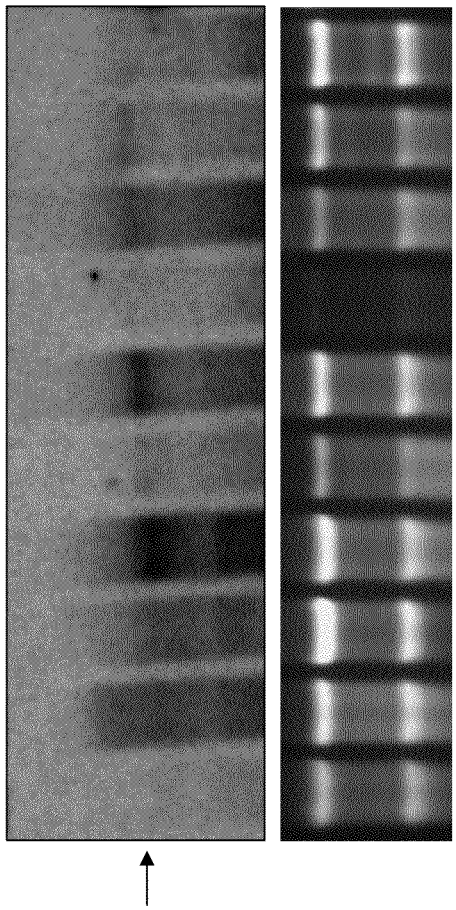

FIG. 25. 158P3D2 Expression in stomach cancer patient specimens by northern blotting. RNA was extracted from normal stomach and a panel of stomach cancer patient specimens. Northern blot with 10 ug of total RNA were probed with the 158P3D2 sequence. Size standards in kilobases are on the side. Results show strong expression of 158P3D2 in tumor specimens but not in the normal tissue.

Figure 26:
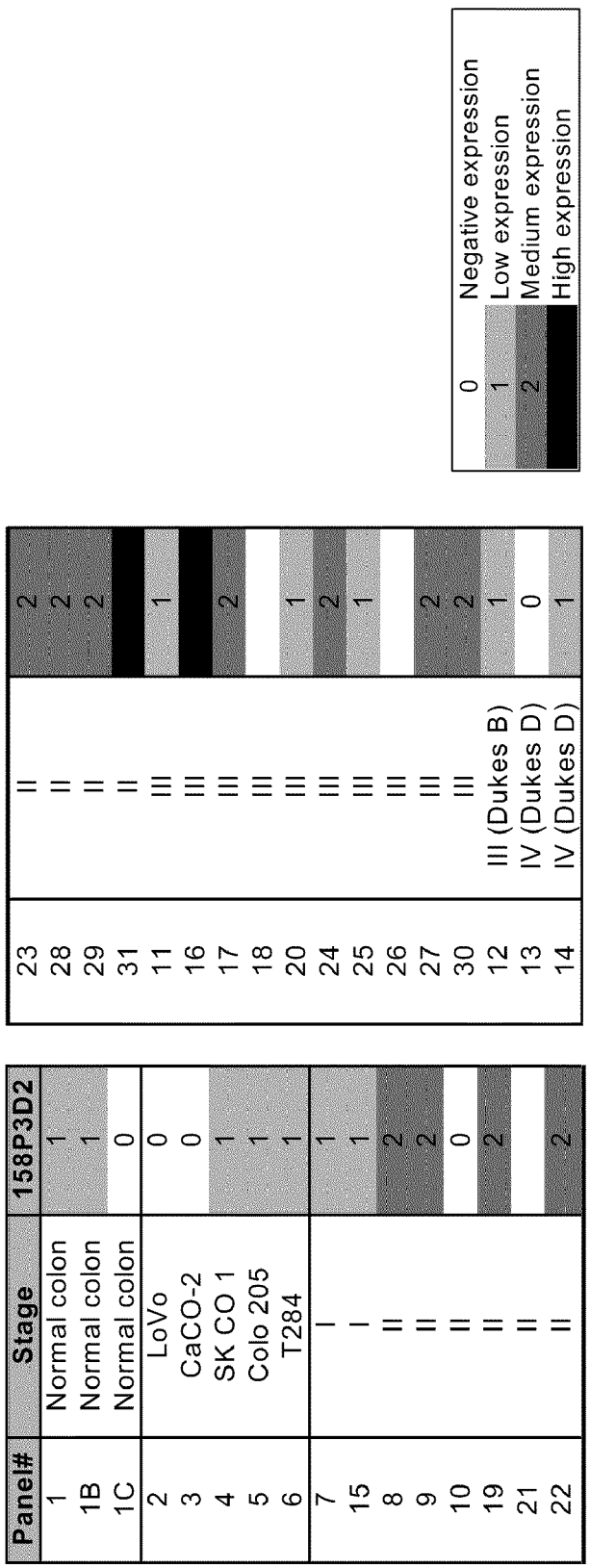

FIG. 26. 158P3D2 Expression in colon cancer patient specimens. First strand cDNA was prepared from normal colon, colon cancer cell lines (LoVo, CaCO-2, SK CO 1, Colo 205, T284), and a panel of colon cancer patient specimens. Normalization was performed by PCR using primers to actin and GAPDH. Semi-quantitative PCR, using primers to 158P3D2, was performed at 26 and 30 cycles of amplification. Expression level was recorded as no expression (no signal detected), low (signal detected at 30x), medium (signal detected at 26x), high (strong signal at 26x). 158P3D2 is expressed at varying levels in the majority of colon cancer patient specimens. But it was weakly expressed in just 2 of 3 normal tissues, and 3 of 5 cell lines tested.

Figure 27:
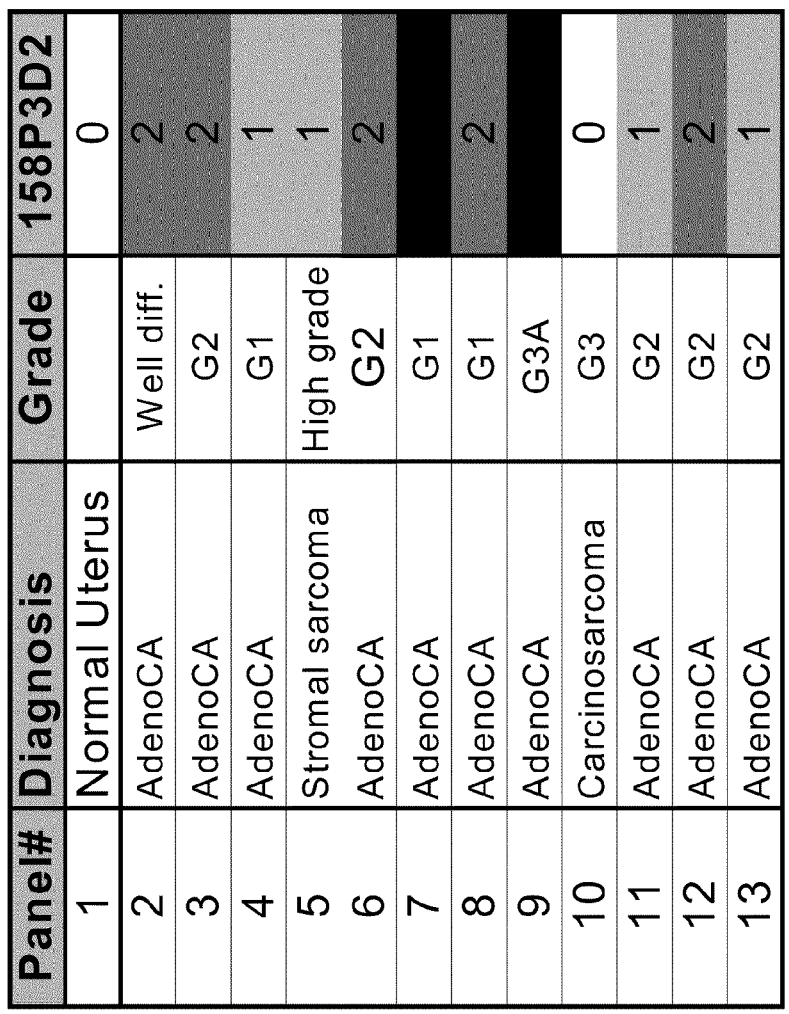

FIG. 27. 158P3D2 Expression in uterus cancer patient specimens. First strand cDNA was prepared from normal uterus and a panel of uterus cancer patient specimens. Normalization was performed by PCR using primers to actin and GAPDH. Semi-quantitative PCR, using primers to 158P3D2, was performed at 26 and 30 cycles of amplification. Expression level was recorded as no expression (no signal detected), low (signal detected at 30x), medium (signal detected at 26x), high (strong signal at 26x). Results show 158P3D2 is expressed at varying levels in the majority of uterus cancer patient specimens, but not in normal uterus.

FIG. 28. 158P3D2 Expression in breast cancer patient specimens. First strand cDNA was prepared from normal breast, breast cancer cell lines (MD-MBA-435S, DU4475, MCF-7, CAMA-1, MCF10A), and a panel of breast cancer patient specimens. Normalization was performed by PCR using primers to actin and GAPDH. Semi-quantitative PCR, using primers to 158P3D2, was performed at 26 and 30 cycles of amplification. Expression level was recorded as no expression (no signal detected), low (signal detected at 30x), medium (signal detected at 26x), high (strong signal at 26x). Results show 158P3D2 is expressed at varying levels in the majority of breast cancer patient specimens. But it was weakly expressed in just 2 of 3 normal tissues, and 2 of 5 cell lines tested.

FIG. 29. Serum titer of mice immunized with KLH-peptide encoding amino acids 315-328 of 158P3D2. Serial dilutions of serum taken from immunized mice were incubated on an ELISA plate coated with the 158P3 D2 peptide conjugated to ovalbumin. Specific bound antibody was then detected by incubation goat anti-mouse IgG-HRP conjugate and then visualized and quantitated by development with TMB substrate and optical density determination.

FIG. 30. Validation of 158P3D2 siRNA oligo. Cos-1 cells were transfected with 1 µg pcDNA3-158P3D2, which encodes a full-length 158P3D2 protein fusion with a Myc/His tag on the C-terminus, simultaneously with Lipofectamine 2000 reagent (LF2k) alone, or with control CT1 oligo (20 nM), 158P3D2.b oligo (20 nM), or no DNA or oligo (No DNA). After 72 hours, the cells were lysed in 1% Triton buffer, and 50 µg of total soluble cell lysate was analyzed by Western blotting. The upper panel was blotted with anti-Myc (1:1000) to detect the 158P3D2-Myc/His fusion protein and the lower panel was developed with anti-actin. The level of 158P3D2 was diminished by the 158P3D2 siRNA oligo, whereas no change was observed with the control (LF2k) or siRNA oligo CT1. In contrast, no change in the level of actin was noted in the cell lysates, indicating that the loading was equivalent in all lanes.

DETAILED DESCRIPTION OF THE INVENTION

Outline of Sections

I.) Definitions
II.) 158P3D2 Polynucleotides
II.A.) Uses of 158P3D2 Polynucleotides
II.A.1.) Monitoring of Genetic Abnormalities
II.A.2.) Antisense Embodiments
II.A.3.) Primers and Primer Pairs
II.A.4.) Isolation of 158P3D2-Encoding Nucleic Acid Molecules
II.A.5.) Recombinant Nucleic Acid Molecules and Host-Vector Systems
III.) 158P3D2-related Proteins
III.A.) Motif-bearing Protein Embodiments
III.B.) Expression of 158P3D2-related Proteins
III.C.) Modifications of 158P3D2-related Proteins
III.D.) Uses of 158P3D2-related Proteins
IV.) 158P3D2 Antibodies
V.) 158P3D2 Cellular Immune Responses
VI.) 158P3D2 Transgenic Animals
VII.) Methods for the Detection of 158P3D2
VIII.) Methods for Monitoring the Status of 158P3D2-related Genes and Their Products
IX.) Identification of Molecules That Interact With 158P3D2
X.) Therapeutic Methods and Compositions
X.A.) Anti-Cancer Vaccines
X.B.) 158P3D2 as a Target for Antibody-Based Therapy
X.C.) 158P3D2 as a Target for Cellular Immune Responses
X.C.1. Minigene Vaccines
X.C.2. Combinations of CTL Peptides with Helper Peptides
X.C.3. Combinations of CTL Peptides with T Cell Priming Agents
X.C.4. Vaccine Compositions Comprising DC Pulsed with CTL and/or HTL Peptides
X.D.) Adoptive Immunotherapy
X.E.) Administration of Vaccines for Therapeutic or Prophylactic Purposes
XI.) Diagnostic and Prognostic Embodiments of 158P3D2.
XII.) Inhibition of 158P3D2 Protein Function
XII.A.) Inhibition of 158P3D2 With Intracellular Antibodies
XII.B.) Inhibition of 158P3D2 with Recombinant Proteins
XII.C.) Inhibition of 158P3D2 Transcription or Translation
XII.D.) General Considerations for Therapeutic Strategies XIII.) Identification, Characterization and Use of Modulators of 109P1D1
XIII.A.) Methods to Identify and Use Modulators
XIII.B.) Gene Expression-related Assays
XIII.C.) Expression Monitoring to Identify Compounds that Modify Gene Expression
XIII.D.) Biological Activity-related Assays
XIII.E.) High Throughput Screening to Identify Modulators
XIII.F.) Use of Soft Agar Growth and Colony Formation to Identify and Characterize Modulators
XIII.G.) Evaluation of Contact Inhibition and Growth Density Limitation to Identify and Characterize Modulators
XIII.H.) Evaluation of Growth Factor or Serum Dependence to Identify and Characterize Modulators
XIII.I.) Use of Tumor-specific Marker Levels to Identify and Characterize Modulators
XIII.J.) Invasiveness into Matrigel to Identify and Characterize Modulators
XIII.K.) Evaluation of Tumor Growth In Vivo to Identify and Characterize Modulators
XIII.L.) In Vitro Assays to Identify and Characterize Modulators
XIII.M.) Binding Assays to Identify and Characterize Modulators
XIII.N.) Competitive Binding to Identify and Characterize Modulators
XIII.O.) Use of Polynucleotides to Down-regulate or Inhibit a Protein of the Invention.
XIII.P.) Inhibitory and Antisense Nucleotides
XIII.Q.) Ribozymes
XIII.R.) Use of Modulators in Phenotypic Screening
XIII.S.) Use of Modulators to Affect Peptides of the Invention
XIII.T.) Methods of Identifying Characterizing Cancer-associated Sequences
XIV.) KITS/Articles of Manufacture

I.) DEFINITIONS

Unless otherwise defined, all terms of art, notations and other scientific terms or terminology used herein are intended to have the meanings commonly understood by those of skill in the art to which this invention pertains. In some cases, terms with commonly understood meanings are defined herein for clarity and/or for ready reference, and the inclusion of such definitions herein should not necessarily be construed to represent a substantial difference over what is generally understood in the art. Many of the techniques and procedures described or referenced herein are well understood and commonly employed using conventional methodology by those skilled in the art, such as, for example, the widely utilized molecular cloning methodologies described in Sambrook et al., Molecular Cloning: A Laboratory Manual 2nd. edition (1989) Cold Spring Harbor Laboratory Press, Cold Spring Harbor, N.Y. As appropriate, procedures involving the use of commercially available kits and reagents are generally carried out in accordance with manufacturer defined protocols and/or parameters unless otherwise noted.

The terms "advanced prostate cancer", "locally advanced prostate cancer", "advanced disease" and "locally advanced disease" mean prostate cancers that have extended through the prostate capsule, and are meant to include stage C disease under the American Urological Association (AUA) system, stage C1-C2 disease under the Whitmore-Jewett system, and stage T3-T4 and N+ disease under the TNM (tumor, node, metastasis) system. In general, surgery is not recommended for patients with locally advanced disease, and these patients have substantially less favorable outcomes compared to patients having clinically localized (organ-confined) prostate cancer. Locally advanced disease is clinically identified by palpable evidence of induration beyond the lateral border of the prostate, or asymmetry or induration above the prostate base. Locally advanced prostate cancer is presently diagnosed pathologically following radical prostatectomy if the tumor invades or penetrates the prostatic capsule, extends into the surgical margin, or invades the seminal vesicles.

"Altering the native glycosylation pattern" is intended for purposes herein to mean deleting one or more carbohydrate moieties found in native sequence 158P3D2 (either by removing the underlying glycosylation site or by deleting the glycosylation by chemical and/or enzymatic means), and/or adding one or more glycosylation sites that are not present in the native sequence 158P3D2. In addition, the phrase includes qualitative changes in the glycosylation of the native proteins, involving a change in the nature and proportions of the various carbohydrate moieties present.

The term "analog" refers to a molecule which is structurally similar or shares similar or corresponding attributes with another molecule (e.g. a 158P3D2-related protein). For example, an analog of a 158P3D2 protein can be specifically bound by an antibody or T cell that specifically binds to 158P3D2.

The term "antibody" is used in the broadest sense. Therefore, an "antibody" can be naturally occurring or man-made such as monoclonal antibodies produced by conventional hybridoma technology. Anti-158P3D2 antibodies comprise monoclonal and polyclonal antibodies as well as fragments containing the antigen-binding domain and/or one or more complementarity determining regions of these antibodies.

An "antibody fragment" is defined as at least a portion of the variable region of the immunoglobulin molecule that binds to its target, i.e., the antigen-binding region. In one embodiment it specifically covers single anti-158P3D2 antibodies and clones thereof (including agonist, antagonist and neutralizing antibodies) and anti-158P3D2 antibody compositions with polyepitopic specificity.

The term "codon optimized sequences" refers to nucleotide sequences that have been optimized for a particular host species by replacing any codons having a usage frequency of less than about 20%. Nucleotide sequences that have been optimized for expression in a given host species by elimination of spurious polyadenylation sequences, elimination of exon/intron splicing signals, elimination of transposon-like repeats and/or optimization of GC content in addition to codon optimization are referred to herein as an "expression enhanced sequences."

A "combinatorial library" is a collection of diverse chemical compounds generated by either chemical synthesis or biological synthesis by combining a number of chemical "building blocks" such as reagents. For example, a linear combinatorial chemical library, such as a polypeptide (e.g., mutein) library, is formed by combining a set of chemical building blocks called amino acids in every possible way for a given compound length (i.e., the number of amino acids in a polypeptide compound). Numerous chemical compounds are synthesized through such combinatorial mixing of chemical building blocks (Gallop et al., J. Med. Chem. 37(9): 1233-1251 (1994)).

Preparation and screening of combinatorial libraries is well known to those of skill in the art. Such combinatorial chemical libraries include, but are not limited to, peptide libraries (see, e.g., U.S. Pat. No. 5,010,175, Furka, Pept. Prot. Res. 37:487-493 (1991), Houghton et al., Nature, 354:84-88 (1991)), peptoids (PCT Publication No WO 91/19735), encoded peptides (PCT Publication WO 93/20242), random bio-oligomers (PCT Publication WO 92/00091), benzodiazepines (U.S. Pat. No. 5,288,514), diversomers such as hydantoins, benzodiazepines and dipeptides (Hobbs et al., Proc. Nat. Acad. Sci. USA 90:6909-6913 (1993)), vinylogous polypeptides (Hagihara et al., J. Amer. Chem. Soc. 114:6568 (1992)), nonpeptidal peptidomimetics with a Beta-D-Glucose scaffolding (Hirschmann et al., J. Amer. Chem. Soc. 114:9217-9218 (1992)), analogous organic syntheses of small compound libraries (Chen et al., J. Amer. Chem. Soc. 116:2661 (1994)), oligocarbarnates (Cho, et al., Science 261: 1303 (1993)), and/or peptidyl phosphonates (Campbell et al., J. Org. Chem. 59:658 (1994)). See, generally, Gordon et al., J. Med. Chem. 37:1385 (1994), nucleic acid libraries (see, e.g., Stratagene, Corp.), peptide nucleic acid libraries (see, e.g., U.S. Pat. No. 5,539,083), antibody libraries (see, e.g., Vaughn et al., Nature Biotechnology 14(3): 309-314 (1996), and PCT/US96/10287), carbohydrate libraries (see, e.g., Liang et al., Science 274:1520-1522 (1996), and U.S. Pat. No. 5,593,853), and small organic molecule libraries (see, e.g., benzodiazepines, Baum, C&EN, January 18, page 33 (1993); isoprenoids, U.S. Pat. No. 5,569,588; thiazolidinones and metathiazanones, U.S. Pat. No. 5,549,974; pyrrolidines, U.S. Pat. Nos. 5,525,735 and 5,519,134; morpholino compounds, U.S. Pat. No. 5,506,337; benzodiazepines, U.S. Pat. No. 5,288,514; and the like).

Devices for the preparation of combinatorial libraries are commercially available (see, e.g., 357 NIPS, 390 NIPS, Advanced Chem Tech, Louisville Ky.; Symphony, Rainin, Woburn, Mass.; 433A, Applied Biosystems, Foster City, Calif.; 9050, Plus, Millipore, Bedford, NIA). A number of well-known robotic systems have also been developed for solution phase chemistries. These systems include automated workstations such as the automated synthesis apparatus developed by Takeda Chemical Industries, LTD. (Osaka, Japan) and many robotic systems utilizing robotic arms (Zymate H, Zymark Corporation, Hopkinton, Mass.; Orca, Hewlett-Packard, Palo Alto, Calif.), which mimic the manual synthetic operations performed by a chemist. Any of the above devices are suitable for use with the present invention. The nature and implementation of modifications to these devices (if any) so that they can operate as discussed herein will be apparent to persons skilled in the relevant art. In addition, numerous combinatorial libraries are themselves commercially available (see, e.g., ComGenex, Princeton, N.J.; Asinex, Moscow, RU; Tripos, Inc., St. Louis, Mo.; ChemStar, Ltd, Moscow, RU; 3D Pharmaceuticals, Exton, Pa.; Martek Biosciences, Columbia, Md.; etc.).

The term "cytotoxic agent" refers to a substance that inhibits or prevents the expression activity of cells, function of cells and/or causes destruction of cells. The term is intended to include radioactive isotopes chemotherapeutic agents, and toxins such as small molecule toxins or enzymatically active toxins of bacterial, fungal, plant or animal origin, including fragments and/or variants thereof. Examples of cytotoxic agents include, but are not limited to auristatins, auromycins, maytansinoids, yttrium, bismuth, ricin, ricin A-chain, combrestatin, duocarmycins, dolostatins, doxorubicin, daunorubicin, taxol, cisplatin, cc1065, ethidium bromide, mitomycin, etoposide, tenoposide, vincristine, vinblastine, colchicine, dihydroxy anthracin dione, actinomycin, diphtheria toxin, *Pseudomonas* exotoxin (PE) A, PE40, abrin, abrin A chain, modeccin A chain, alpha-sarcin, gelonin, mitogellin, retstrictocin, phenomycin, enomycin, curicin, crotin, calicheamicin, *Sapaonaria officinalis* inhibitor, and glucocorticoid and other chemotherapeutic agents, as well as radioisotopes such as At211, I131, I125, Y90, Re186, Re188, Sm153, Bi212 or 213, P32 and radioactive isotopes of Lu including Lu177. Antibodies may also be conjugated to an anti-cancer pro-drug activating enzyme capable of converting the pro-drug to its active form.

The "gene product" is sometimes referred to herein as a protein or mRNA. For example, a "gene product of the invention" is sometimes referred to herein as a "cancer amino acid sequence", "cancer protein", "protein of a cancer listed in Table I", a "cancer mRNA", "mRNA of a cancer listed in Table I", etc. In one embodiment, the cancer protein is encoded by a nucleic acid of FIG. 2. The cancer protein can be a fragment, or alternatively, be the full-length protein to the fragment encoded by the nucleic acids of FIG. 2. In one embodiment, a cancer amino acid sequence is used to determine sequence identity or similarity. In another embodiment, the sequences are naturally occurring allelic variants of a protein encoded by a nucleic acid of FIG. 2. In another embodiment, the sequences are sequence variants as further described herein.

"High throughput screening" assays for the presence, absence, quantification, or other properties of particular nucleic acids or protein products are well known to those of skill in the art. Similarly, binding assays and reporter gene assays are similarly well known. Thus, e.g., U.S. Pat. No. 5,559,410 discloses high throughput screening methods for proteins; U.S. Pat. No. 5,585,639 discloses high throughput screening methods for nucleic acid binding (i.e., in arrays); while U.S. Pat. Nos. 5,576,220 and 5,541,061 disclose high throughput methods of screening for ligand/antibody binding.

In addition, high throughput screening systems are commercially available (see, e.g., Amersham Biosciences, Piscataway, N.J.; Zymark Corp., Hopkinton, Mass.; Air Technical Industries, Mentor, Ohio; Beckman Instruments, Inc. Fullerton, Calif.; Precision Systems, Inc., Natick, Mass.; etc.). These systems typically automate entire procedures, including all sample and reagent pipetting, liquid dispensing, timed incubations, and final readings of the microplate in detector(s) appropriate for the assay. These configurable systems provide high throughput and rapid start up as well as a high degree of flexibility and customization. The manufacturers of such systems provide detailed protocols for various high throughput systems. Thus, e.g., Zymark Corp. provides technical bulletins describing screening systems for detecting the modulation of gene transcription, ligand binding, and the like.

The term "homolog" refers to a molecule which exhibits homology to another molecule, by for example, having sequences of chemical residues that are the same or similar at corresponding positions.

"Human Leukocyte Antigen" or "HLA" is a human class I or class II Major Histocompatibility Complex (MHC) protein (see, e.g., Stites, et al., Immunology, 8th Ed., Lange Publishing, Los Altos, Calif. (1994).

The terms "hybridize", "hybridizing", "hybridizes" and the like, used in the context of polynucleotides, are meant to refer to conventional hybridization conditions, preferably such as hybridization in 50% formamide/6×SSC/0.1% SDS/100 µg/ml ssDNA, in which temperatures for hybridization are above 37 degrees C. and temperatures for washing in 0.1×SSC/0.1% SDS are above 55 degrees C.

The phrases "isolated" or "biologically pure" refer to material which is substantially or essentially free from components which normally accompany the material as it is found in its native state. Thus, isolated peptides in accordance with the invention preferably do not contain materials normally associated with the peptides in their in situ environment. For example, a polynucleotide is said to be "isolated" when it is substantially separated from contaminant polynucleotides that correspond or are complementary to genes other than the 158P3D2 genes or that encode polypeptides other than 158P3D2 gene product or fragments thereof. A skilled artisan can readily employ nucleic acid isolation procedures to obtain an isolated 158P3D2 polynucleotide. A protein is said to be "isolated," for example, when physical, mechanical or chemical methods are employed to remove the 158P3D2 proteins from cellular constituents that are normally associated with the protein. A skilled artisan can readily employ standard purification methods to obtain an isolated 158P3D2 protein. Alternatively, an isolated protein can be prepared by chemical means.

The term "mammal" refers to any organism classified as a mammal, including mice, rats, rabbits, dogs, cats, cows, horses and humans. In one embodiment of the invention, the mammal is a mouse. In another embodiment of the invention, the mammal is a human.

The terms "metastatic prostate cancer" and "metastatic disease" mean prostate cancers that have spread to regional lymph nodes or to distant sites, and are meant to include stage D disease under the AUA system and stage TxNxM+ under the TNM system. As is the case with locally advanced prostate cancer, surgery is generally not indicated for patients with metastatic disease, and hormonal (androgen ablation) therapy is a preferred treatment modality. Patients with metastatic prostate cancer eventually develop an androgen-refractory state within 12 to 18 months of treatment initiation. Approximately half of these androgen-refractory patients die within 6 months after developing that status. The most common site for prostate cancer metastasis is bone. Prostate cancer bone metastases are often osteoblastic rather than osteolytic (i.e., resulting in net bone formation). Bone metastases are found most frequently in the spine, followed by the femur, pelvis, rib cage, skull and humerus. Other common sites for metastasis include lymph nodes, lung, liver and brain. Metastatic prostate cancer is typically diagnosed by open or laparoscopic pelvic lymphadenectomy, whole body radionuclide scans, skeletal radiography, and/or bone lesion biopsy.

The term "modulator" or "test compound" or "drug candidate" or grammatical equivalents as used herein describe any molecule, e.g., protein, oligopeptide, small organic molecule, polysaccharide, polynucleotide, etc., to be tested for the capacity to directly or indirectly alter the cancer phenotype or the expression of a cancer sequence, e.g., a nucleic acid or protein sequences, or effects of cancer sequences (e.g., signaling, gene expression, protein interaction, etc.) In one aspect, a modulator will neutralize the effect of a cancer protein of the invention. By "neutralize" is meant that an activity of a protein is inhibited or blocked, along with the consequent effect on the cell. In another aspect, a modulator will neutralize the effect of a gene, and its corresponding protein, of the invention by normalizing levels of said protein. In preferred embodiments, modulators alter expression profiles, or expression profile nucleic acids or proteins provided herein, or downstream effector pathways. In one embodiment, the modulator suppresses a cancer phenotype, e.g. to a normal tissue fingerprint. In another embodiment, a modulator induced a cancer phenotype. Generally, a plurality of assay mixtures is run in parallel with different agent concentrations to obtain a differential response to the various concentrations. Typically, one of these concentrations serves as a negative control, i.e., at zero concentration or below the level of detection.

Modulators, drug candidates or test compounds encompass numerous chemical classes, though typically they are organic molecules, preferably small organic compounds having a molecular weight of more than 100 and less than about 2,500 Daltons. Preferred small molecules are less than 2000, or less than 1500 or less than 1000 or less than 500 D. Candidate agents comprise functional groups necessary for structural interaction with proteins, particularly hydrogen bonding, and typically include at least an amine, carbonyl, hydroxyl or carboxyl group, preferably at least two of the functional chemical groups. The candidate agents often comprise cyclical carbon or heterocyclic structures and/or aromatic or polyaromatic structures substituted with one or more of the above functional groups. Modulators also comprise biomolecules such as peptides, saccharides, fatty acids, steroids, purines, pyrimidines, derivatives, structural analogs or combinations thereof. Particularly preferred are peptides. One class of modulators are peptides, for example of from about five to about 35 amino acids, with from about five to about 20 amino acids being preferred, and from about 7 to about 15 being particularly preferred. Preferably, the cancer modulatory protein is soluble, includes a non-transmembrane region, and/or, has an N-terminal Cys to aid in solubility. In one embodiment, the C-terminus of the fragment is kept as a free acid and the N-terminus is a free amine to aid in coupling, i.e., to cysteine. In one embodiment, a cancer protein of the invention is conjugated to an immunogenic agent as discussed herein. In one embodiment, the cancer protein is conjugated to BSA. The peptides of the invention, e.g., of preferred lengths, can be linked to each other or to other amino acids to create a longer peptide/protein. The modulatory peptides can be digests of naturally occurring proteins as is outlined above, random peptides, or "biased" random peptides. In a preferred embodiment, peptide/protein-based modulators are antibodies, and fragments thereof, as defined herein.

Modulators of cancer can also be nucleic acids. Nucleic acid modulating agents can be naturally occurring nucleic acids, random nucleic acids, or "biased" random nucleic acids. For example, digests of prokaryotic or eukaryotic genomes can be used in an approach analogous to that outlined above for proteins.

The term "monoclonal antibody" refers to an antibody obtained from a population of substantially homogeneous antibodies, i.e., the antibodies comprising the population are identical except for possible naturally occurring mutations that are present in minor amounts.

A "motif", as in biological motif of a 158P3D2-related protein, refers to any pattern of amino acids forming part of the primary sequence of a protein, that is associated with a particular function (e.g. protein-protein interaction, protein-DNA interaction, etc) or modification (e.g. that is phosphorylated, glycosylated or amidated), or localization (e.g. secretory sequence, nuclear localization sequence, etc.) or a sequence that is correlated with being immunogenic, either humorally or cellularly. A motif can be either contiguous or capable of being aligned to certain positions that are generally correlated with a certain function or property. In the context of HLA motifs, "motif" refers to the pattern of residues in a peptide of defined length, usually a peptide of from about 8 to about 13 amino acids for a class I HLA motif and from about 6 to about 25 amino acids for a class II HLA motif, which is recognized by a particular HLA molecule. Peptide motifs for HLA binding are typically different for each protein encoded by each human HLA allele and differ in the pattern of the primary and secondary anchor residues.

A "pharmaceutical excipient" comprises a material such as an adjuvant, a carrier, pH-adjusting and buffering agents, tonicity adjusting agents, wetting agents, preservative, and the like.

"Pharmaceutically acceptable" refers to a non-toxic, inert, and/or composition that is physiologically compatible with humans or other mammals.

The term "polynucleotide" means a polymeric form of nucleotides of at least 10 bases or base pairs in length, either ribonucleotides or deoxynucleotides or a modified form of either type of nucleotide, and is meant to include single and double stranded forms of DNA and/or RNA. In the art, this term if often used interchangeably with "oligonucleotide". A polynucleotide can comprise a nucleotide sequence disclosed herein wherein thymidine (T), as shown for example in FIG. 2, can also be uracil (U); this definition pertains to the differences between the chemical structures of DNA and RNA, in particular the observation that one of the four major bases in RNA is uracil (U) instead of thymidine (T).

The term "polypeptide" means a polymer of at least about 4, 5, 6, 7, or 8 amino acids. Throughout the specification, standard three letter or single letter designations for amino acids are used. In the art, this term is often used interchangeably with "peptide" or "protein".

An HLA "primary anchor residue" is an amino acid at a specific position along a peptide sequence which is understood to provide a contact point between the immunogenic peptide and the HLA molecule. One to three, usually two, primary anchor residues within a peptide of defined length generally defines a "motif" for an immunogenic peptide. These residues are understood to fit in close contact with peptide binding groove of an HLA molecule, with their side chains buried in specific pockets of the binding groove. In one embodiment, for example, the primary anchor residues for an HLA class I molecule are located at position 2 (from the amino terminal position) and at the carboxyl terminal position of a 8, 9, 10, 11, or 12 residue peptide epitope in accordance with the invention. Alternatively, in another embodiment, the primary anchor residues of a peptide binds an HLA class II molecule are spaced relative to each other, rather than to the termini of a peptide, where the peptide is generally of at least 9 amino acids in length. The primary anchor positions for each motif and supermotif are set forth in Table IV. For example, analog peptides can be created by altering the presence or absence of particular residues in the primary and/or secondary anchor positions shown in Table IV. Such analogs are used to modulate the binding affinity and/or population coverage of a peptide comprising a particular HLA motif or supermotif.

"Radioisotopes" include, but are not limited to the following (non-limiting exemplary uses are also set forth):

Examples of Medical Isotopes

| Isotope | Description of use |
| --- | --- |
| Actinium-225 (AC-225) | See Thorium-229 (Th-229) |
| Actinium-227 (AC-227) | Parent of Radium-223 (Ra-223) which is an alpha emitter used to treat metastases in the skeleton resulting from cancer (i.e., breast and prostate cancers), and cancer radioimmunotherapy |
| Bismuth-212 (Bi-212) | See Thorium-228 (Th-228) |
| Bismuth-213 (Bi-213) | See Thorium-229 (Th-229) |
| Cadmium-109 (Cd-109) | Cancer detection |
| Cobalt-60 (Co-60) | Radiation source for radiotherapy of cancer, for food irradiators, and for sterilization of medical supplies |
| Copper-64 (Cu-64) | A positron emitter used for cancer therapy and SPECT imaging |
| Copper-67 (Cu-67) | Beta/gamma emitter used in cancer radioimmunotherapy and diagnostic studies (i.e., breast and colon cancers, and lymphoma) |
| Dysprosium-166 (Dy-166) | Cancer radioimmunotherapy |
| Erbium-169 (Er-169) | Rheumatoid arthritis treatment, particularly for the small joints associated with fingers and toes |
| Europium-152 (Eu-152) | Radiation source for food irradiation and for sterilization of medical supplies |
| Europium-154 (Eu-154) | Radiation source for food irradiation and for sterilization of medical supplies |
| Gadolinium-153 (Gd-153) | Osteoporosis detection and nuclear medical quality assurance devices |
| Gold-198 (Au-198) | Implant and intracavity therapy of ovarian, prostate, and brain cancers |
| Holmium-166 (Ho-166) | Multiple myeloma treatment in targeted skeletal therapy, cancer radioimmunotherapy, bone marrow ablation, and rheumatoid arthritis treatment |
| Iodine-125 (I-125) | Osteoporosis detection, diagnostic imaging, tracer drugs, brain cancer treatment, radiolabeling, tumor imaging, mapping of receptors in the brain, interstitial radiation therapy, brachytherapy for treatment of prostate cancer, determination of glomerular filtration rate (GFR), determination of plasma volume, detection of deep vein thrombosis of the legs |
| Iodine-131 (I-131) | Thyroid function evaluation, thyroid disease detection, treatment of thyroid cancer as well as other non-malignant thyroid diseases (i.e., Graves disease, goiters, and hyperthyroidism), treatment of leukemia, lymphoma, and other forms of cancer (e.g., breast cancer) using radioimmunotherapy |
| Iridium-192 (Ir-192) | Brachytherapy, brain and spinal cord tumor treatment, treatment of blocked arteries (i.e., arteriosclerosis and restenosis), and implants for breast and prostate tumors |
| Lutetium-177 (Lu-177) | Cancer radioimmunotherapy and treatment of blocked arteries (i.e., arteriosclerosis and restenosis) |

-continued

| Isotope | Description of use |
|---|---|
| Molybdenum-99 (Mo-99) | Parent of Technetium-99m (Tc-99m) which is used for imaging the brain, liver, lungs, heart, and other organs. Currently, Tc-99m is the most widely used radioisotope used for diagnostic imaging of various cancers and diseases involving the brain, heart, liver, lungs; also used in detection of deep vein thrombosis of the legs |
| Osmium-194 (Os-194) | Cancer radioimmunotherapy |
| Palladium-103 (Pd-103) | Prostate cancer treatment |
| Platinum-195m (Pt-195m) | Studies on biodistribution and metabolism of cisplatin, a chemotherapeutic drug |
| Phosphorus-32 (P-32) | Polycythemia rubra vera (blood cell disease) and leukemia treatment, bone cancer diagnosis/treatment; colon, pancreatic, and liver cancer treatment; radiolabeling nucleic acids for in vitro research, diagnosis of superficial tumors, treatment of blocked arteries (i.e., arteriosclerosis and restenosis), and intracavity therapy |
| Phosphorus-33 (P-33) | Leukemia treatment, bone disease diagnosis/treatment, radiolabeling, and treatment of blocked arteries (i.e., arteriosclerosis and restenosis) |
| Radium-223 (Ra-223) | See Actinium-227 (Ac-227) |
| Rhenium-186 (Re-186) | Bone cancer pain relief, rheumatoid arthritis treatment, and diagnosis and treatment of lymphoma and bone, breast, colon, and liver cancers using radioimmunotherapy |
| Rhenium-188 (Re-188) | Cancer diagnosis and treatment using radioimmunotherapy, bone cancer pain relief, treatment of rheumatoid arthritis, and treatment of prostate cancer |
| Rhodium-105 (Rh-105) | Cancer radioimmunotherapy |
| Samarium-145 (Sm-145) | Ocular cancer treatment |
| Samarium-153 (Sm-153) | Cancer radioimmunotherapy and bone cancer pain relief |
| Scandium-47 (Sc-47) | Cancer radioimmunotherapy and bone cancer pain relief |
| Selenium-75 (Se-75) | Radiotracer used in brain studies, imaging of adrenal cortex by gamma-scintigraphy, lateral locations of steroid secreting tumors, pancreatic scanning, detection of hyperactive parathyroid glands, measure rate of bile acid loss from the endogenous pool |
| Strontium-85 (Sr-85) | Bone cancer detection and brain scans |
| Strontium-89 (Sr-89) | Bone cancer pain relief, multiple myeloma treatment, and osteoblastic therapy |
| Technetium-99m (Tc-99m) | See Molybdenum-99 (Mo-99) |
| Thorium-228 (Th-228) | Parent of Bismuth-212 (Bi-212) which is an alpha emitter used in cancer radioimmunotherapy |
| Thorium-229 (Th-229) | Parent of Actinium-225 (Ac-225) and grandparent of Bismuth-213 (Bi-213) which are alpha emitters used in cancer radioimmunotherapy |
| Thulium-170 (Tm-170) | Gamma source for blood irradiators, energy source for implanted medical devices |
| Tin-117m (Sn-117m) | Cancer immunotherapy and bone cancer pain relief |
| Tungsten-188 (W-188) | Parent for Rhenium-188 (Re-188) which is used for cancer diagnostics/treatment, bone cancer pain relief, rheumatoid arthritis treatment, and treatment of blocked arteries (i.e., arteriosclerosis and restenosis) |
| Xenon-127 (Xe-127) | Neuroimaging of brain disorders, high resolution SPECT studies, pulmonary function tests, and cerebral blood flow studies |
| Ytterbium-175 (Yb-175) | Cancer radioimmunotherapy |
| Yttrium-90 (Y-90) | Microseeds obtained from irradiating Yttrium-89 (Y-89) for liver cancer treatment |
| Yttrium-91 (Y-91) | A gamma-emitting label for Yttrium-90 (Y-90) which is used for cancer radioimmunotherapy (i.e., lymphoma, breast, colon, kidney, lung, ovarian, prostate, pancreatic, and inoperable liver cancers) |

By "randomized" or grammatical equivalents as herein applied to nucleic acids and proteins is meant that each nucleic acid and peptide consists of essentially random nucleotides and amino acids, respectively. These random peptides (or nucleic acids, discussed herein) can incorporate any nucleotide or amino acid at any position. The synthetic process can be designed to generate randomized proteins or nucleic acids, to allow the formation of all or most of the possible combinations over the length of the sequence, thus forming a library of randomized candidate bioactive proteinaceous agents.

In one embodiment, a library is "fully randomized," with no sequence preferences or constants at any position. In another embodiment, the library is a "biased random" library. That is, some positions within the sequence either are held constant, or are selected from a limited number of possibilities. For example, the nucleotides or amino acid residues are randomized within a defined class, e.g., of hydrophobic amino acids, hydrophilic residues, sterically biased (either small or large) residues, towards the creation of nucleic acid binding domains, the creation of cysteines, for cross-linking, prolines for SH-3 domains, serines, threonines, tyrosines or histidines for phosphorylation sites, etc., or to purines, etc.

A "recombinant" DNA or RNA molecule is a DNA or RNA molecule that has been subjected to molecular manipulation in vitro.

Non-limiting examples of small molecules include compounds that bind or interact with 158P3D2, ligands including hormones, neuropeptides, chemokines, odorants, phospholipids, and functional equivalents thereof that bind and preferably inhibit 158P3D2 protein function. Such non-limiting small molecules preferably have a molecular weight of less than about 10 kDa, more preferably below about 9, about 8, about 7, about 6, about 5 or about 4 kDa. In certain embodiments, small molecules physically associate with, or bind, 158P3D2 protein; are not found in naturally occurring metabolic pathways; and/or are more soluble in aqueous than non-aqueous solutions.

"Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured nucleic acid sequences to reanneal when complementary strands are present in an environment below their melting temperature. The higher the degree of desired homology between the probe and hybridizable sequence, the higher the relative temperature that can be used. As a result, it follows that higher relative temperatures would tend to make the reaction conditions more stringent, while lower temperatures less so. For additional details and explanation of stringency of hybridization reactions, see Ausubel et al., Current Protocols in Molecular Biology, Wiley Interscience Publishers, (1995).

"Stringent conditions" or "high stringency conditions", as defined herein, are identified by, but not limited to, those that: (1) employ low ionic strength and high temperature for washing, for example 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 μg/ml), 0.1% SDS, and 10% dextran sulfate at 42° C., with washes at 42° C. in 0.2×SSC (sodium chloride/sodium citrate) and 50% formamide at 55° C., followed by a high-stringency wash consisting of 0.1×SSC containing EDTA at 55° C. "Moderately stringent conditions" are described by, but not limited to, those in Sambrook et al., Molecular Cloning: A Laboratory Manual, New York: Cold Spring Harbor Press, 1989, and include the use of washing solution and hybridization conditions (e.g., temperature, ionic strength and % SDS) less stringent than those described above. An example of moderately stringent conditions is overnight incubation at 37° C. in a solution comprising: 20% formamide, 5×SSC (150 mM NaCl, 15 mM trisodium citrate), 50 mM sodium phosphate (pH 7.6), 5×Denhardt's solution, 10% dextran sulfate, and 20 mg/mL denatured sheared salmon sperm DNA, followed by washing the filters in 1×SSC at about 37-50° C. The skilled artisan will recognize how to adjust the temperature, ionic strength, etc. as necessary to accommodate factors such as probe length and the like.

An HLA "supermotif" is a peptide binding specificity shared by HLA molecules encoded by two or more HLA alleles. Overall phenotypic frequencies of HLA-supertypes in different ethnic populations are set forth in Table IV (F). The non-limiting constituents of various supetypes are as follows:

A2: A*0201, A*0202, A*0203, A*0204, A*0205, A*0206, A*6802, A*6901, A*0207

A3: A3, A11, A31, A*3301, A*6801, A*0301, A*1101, A*3101

B7: B7, B*3501-03, B*51, B*5301, B*5401, B*5501, B*5502, B*5601, B*6701, B*7801, B*0702, B*5101, B*5602

B44: B*3701, B*4402, B*4403, B*60 (B*4001), B61 (B*4006)

A1: A*0102, A*2604, A*3601, A*4301, A*8001

A24: A*24, A*30, A*2403, A*2404, A*3002, A*3003

B27: B*1401-02, B*1503, B*1509, B*1510, B*1518, B*3801-02, B*3901, B*3902, B*3903-04, B*4801-02, B*7301, B*2701-08

B58: B*1516, B*1517, B*5701, B*5702, B58

B62: B*4601, B52, B*1501 (B62), B*1502 (B75), B*1513 (B77)

Calculated population coverage afforded by different HLA-supertype combinations are set forth in Table IV (G).

As used herein "to treat" or "therapeutic" and grammatically related terms, refer to any improvement of any consequence of disease, such as prolonged survival, less morbidity, and/or a lessening of side effects which are the byproducts of an alternative therapeutic modality; full eradication of disease is not required.

A "transgenic animal" (e.g., a mouse or rat) is an animal having cells that contain a transgene, which transgene was introduced into the animal or an ancestor of the animal at a prenatal, e.g., an embryonic stage. A "transgene" is a DNA that is integrated into the genome of a cell from which a transgenic animal develops.

As used herein, an HLA or cellular immune response "vaccine" is a composition that contains or encodes one or more peptides of the invention. There are numerous embodiments of such vaccines, such as a cocktail of one or more individual peptides; one or more peptides of the invention comprised by a polyepitopic peptide; or nucleic acids that encode such individual peptides or polypeptides, e.g., a minigene that encodes a polyepitopic peptide. The "one or more peptides" can include any whole unit integer from 1-150 or more, e.g., at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, 100, 105, 110, 115, 120, 125, 130, 135, 140, 145, or 150 or more peptides of the invention. The peptides or polypeptides can optionally be modified, such as by lipidation, addition of targeting or other sequences. HLA class I peptides of the invention can be admixed with, or linked to, HLA class II peptides, to facilitate activation of both cytotoxic T lymphocytes and helper T lymphocytes. HLA vaccines can also comprise peptide-pulsed antigen presenting cells, e.g., dendritic cells.

The term "variant" refers to a molecule that exhibits a variation from a described type or norm, such as a protein that has one or more different amino acid residues in the corresponding position(s) of a specifically described protein (e.g. the 158P3D2 protein shown in FIG. 2 or FIG. 3. An analog is an example of a variant protein. Splice isoforms and single nucleotides polymorphisms (SNPs) are further examples of variants.

The "158P3D2-related proteins" of the invention include those specifically identified herein, as well as allelic variants, conservative substitution variants, analogs and homologs that can be isolated/generated and characterized without undue experimentation following the methods outlined herein or readily available in the art. Fusion proteins that combine parts of different 158P3D2 proteins or fragments thereof, as well as fusion proteins of a 158P3D2 protein and a heterologous polypeptide are also included. Such 158P3D2 proteins are collectively referred to as the 158P3D2-related proteins, the proteins of the invention, or 158P3D2. The term "158P3D2-related protein" refers to a polypeptide fragment or a 158P3D2 protein sequence of 4, 5, 6, 7, 8, 9, 10, 11, 12, 13, 14, 15, 16, 17, 18, 19, 20, 21, 22, 23, 24, 25, or more than 25 amino acids; or, at least 30, 35, 40, 45, 50, 55, 60, 65, 70, 80, 85, 90, 95, 100, 105, 110, 115, 120, 125, 130, 135, 140, 145, 150, 155, 160, 165, 170, 175, 180, 185, 190, 195, 200, 225, 250, 275, 300, 325, 350, 375, 400, 425, 450, 475, 500, 525, 550, 575, or 576 or more amino acids.

II.) 158P3D2 POLYNUCLEOTIDES

One aspect of the invention provides polynucleotides corresponding or complementary to all or part of a 158P3D2 gene, mRNA, and/or coding sequence, preferably in isolated form, including polynucleotides encoding a 158P3D2-related protein and fragments thereof, DNA, RNA, DNA/RNA hybrid, and related molecules, polynucleotides or oligonucleotides complementary to a 158P3D2 gene or mRNA sequence or a part thereof, and polynucleotides or oligonucleotides that hybridize to a 158P3D2 gene, mRNA, or to a 158P3D2 encoding polynucleotide (collectively, "158P3D2 polynucleotides"). In all instances when referred to in this section, T can also be U in FIG. 2.

Figures 5, 10:
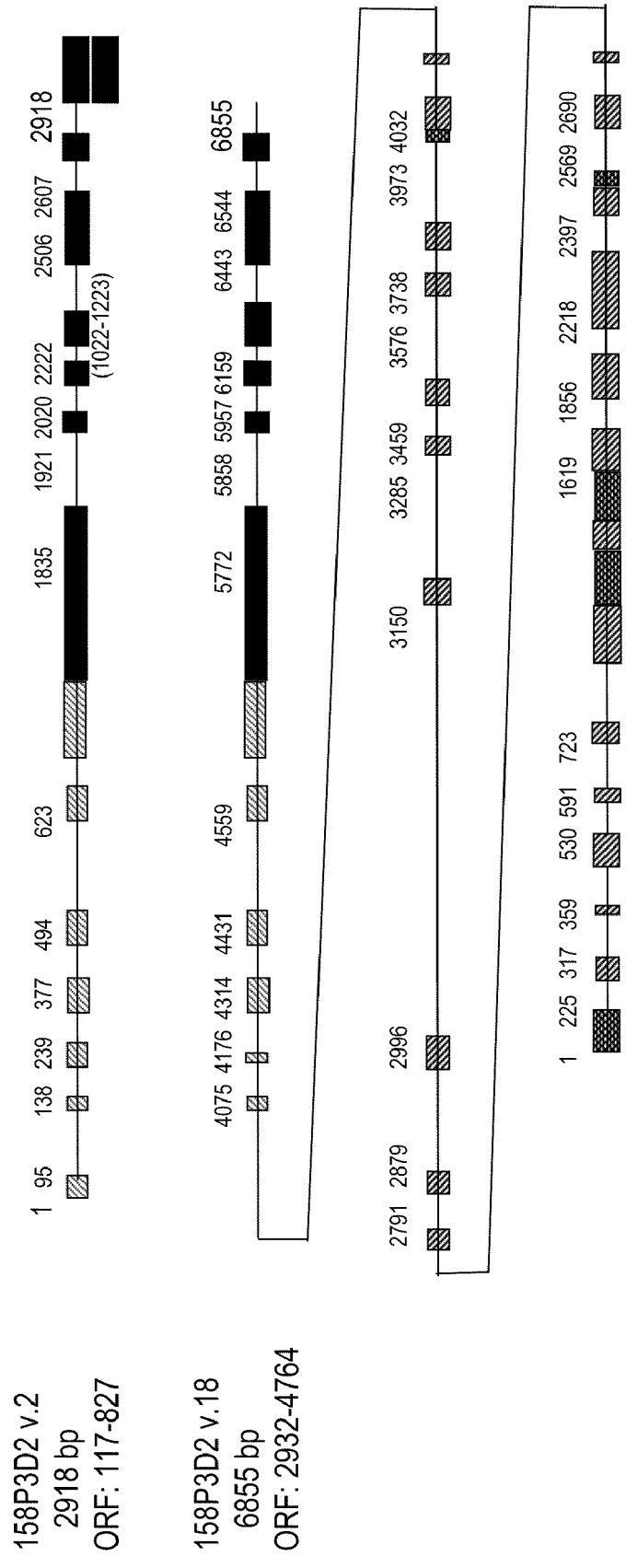
Figures 6, 10:
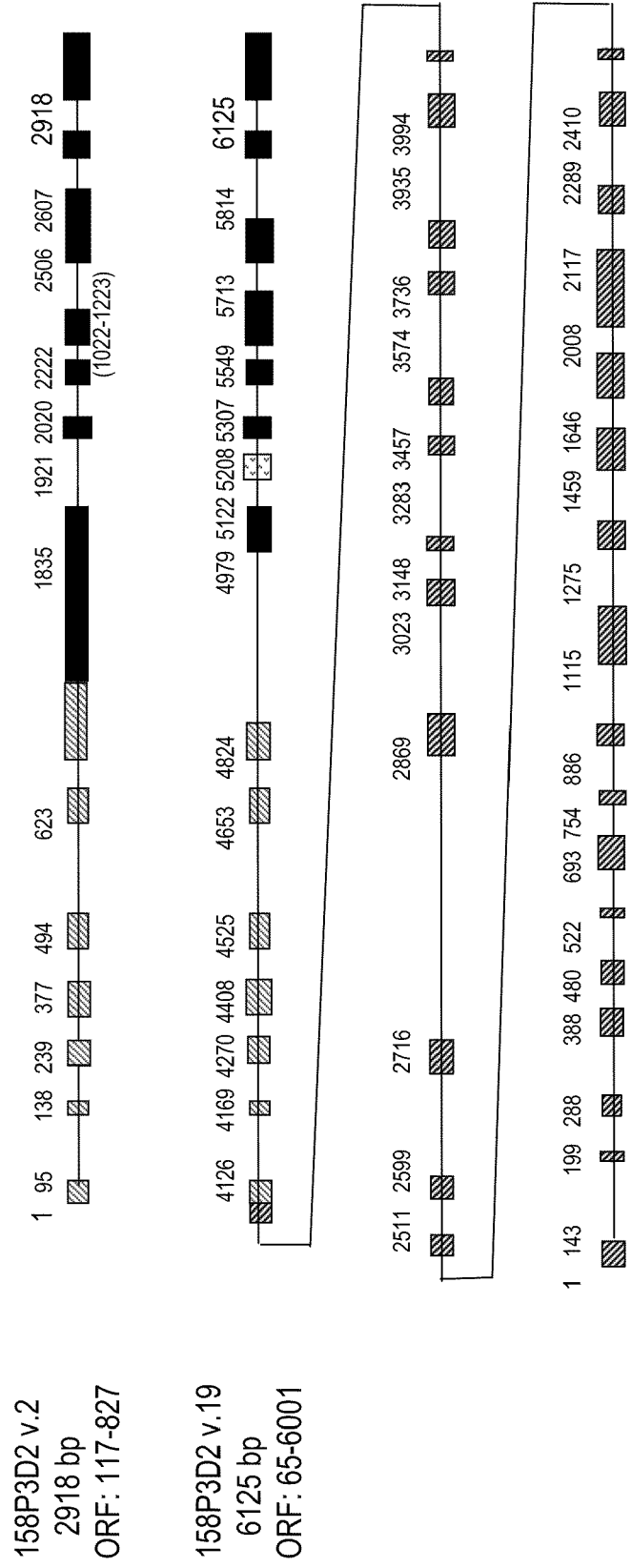
Figures 7, 10:

Embodiments of a 158P3D2 polynucleotide include: a 158P3D2 polynucleotide having the sequence shown in FIG. 2, the nucleotide sequence of 158P3D2 as shown in FIG. 2 wherein T is U; at least 10 contiguous nucleotides of a polynucleotide having the sequence as shown in FIG. 2; or, at least 10 contiguous nucleotides of a polynucleotide having the sequence as shown in FIG. 2 where T is U. For example, embodiments of 158P3D2 nucleotides comprise, without limitation:

(I) a polynucleotide comprising, consisting essentially of, or consisting of a sequence as shown in FIG. 2, wherein T can also be U;

(II) a polynucleotide comprising, consisting essentially of, or consisting of the sequence as shown in FIG. 2A, from nucleotide residue number 849 through nucleotide residue number 1835, including the stop codon, wherein T can also be U;

(III) a polynucleotide comprising, consisting essentially of, or consisting of the sequence as shown in FIG. 2B, from nucleotide residue number 117 through nucleotide residue number 827, including the stop codon, wherein T can also be U;

(IV) a polynucleotide comprising, consisting essentially of, or consisting of the sequence as shown in FIG. 2C, from nucleotide residue number 2249 through nucleotide residue number 2794, including the a stop codon, wherein T can also be U;

(V) a polynucleotide comprising, consisting essentially of, or consisting of the sequence as shown in FIG. 2D, from nucleotide residue number 849 through nucleotide residue number 1835, including the stop codon, wherein T can also be U;

(VI) a polynucleotide comprising, consisting essentially of, or consisting of the sequence as shown in FIG. 2E, from nucleotide residue number 849 through nucleotide residue number 1835, including the stop codon, wherein T can also be U;

(VII) a polynucleotide comprising, consisting essentially of, or consisting of the sequence as shown in FIG. 2F, from nucleotide residue number 849 through nucleotide residue number 1835, including the stop codon, wherein T can also be U;

(VIII) a polynucleotide comprising, consisting essentially of, or consisting of the sequence as shown in FIG. 2G, from nucleotide residue number 1289 through nucleotide residue number 1834, including the stop codon, wherein T can also be U;

(IX) a polynucleotide comprising, consisting essentially of, or consisting of the sequence as shown in FIG. 2H, from nucleotide residue number 849 through nucleotide residue number 1835, including the stop codon, wherein T can also be U;

(X) a polynucleotide comprising, consisting essentially of, or consisting of the sequence as shown in FIG. 2I, from nucleotide residue number 849 through nucleotide residue number 1835, including the stop codon, wherein T can also be U;

(XI) a polynucleotide comprising, consisting essentially of, or consisting of the sequence as shown in FIG. 2J, from nucleotide residue number 849 through nucleotide residue number 1835, including the stop codon, wherein T can also be U;

(XII) a polynucleotide comprising, consisting essentially of, or consisting of the sequence as shown in FIG. 2K, from nucleotide residue number 65 through nucleotide residue number 4246, including the stop codon, wherein T can also be U;

(XIII) a polynucleotide comprising, consisting essentially of, or consisting of the sequence as shown in FIG. 2L, from nucleotide residue number 65 through nucleotide residue number 3502, including the stop codon, wherein T can also be U;

(XIV) a polynucleotide comprising, consisting essentially of, or consisting of the sequence as shown in FIG. 2M, from nucleotide residue number 65 through nucleotide residue number 6037, including the stop codon, wherein T can also be U;

(XV) a polynucleotide comprising, consisting essentially of, or consisting of the sequence as shown in FIG. 2N, from nucleotide residue number 65 through nucleotide residue number 6175, including the stop codon, wherein T can also be U;

(XVI) a polynucleotide comprising, consisting essentially of, or consisting of the sequence as shown in FIG. 2O, from nucleotide residue number 2932 through nucleotide residue number 4764, including the stop codon, wherein T can also be U;

(XVII) a polynucleotide comprising, consisting essentially of, or consisting of the sequence as shown in FIG. 2P, from nucleotide residue number 65 through nucleotide residue number 6001, including the stop codon, wherein T can also be U;

(XVIII) a polynucleotide comprising, consisting essentially of, or consisting of the sequence as shown in FIG. 2Q, from nucleotide residue number 65 through nucleotide residue number 6121, including the stop codon, wherein T can also be U;

(XIX) a polynucleotide that encodes a 158P3D2-related protein that is at least 90, 91, 92, 93, 94, 95, 96, 97, 98, 99 or 100% homologous to an entire amino acid sequence shown in FIG. 2A-Q;

(XX) a polynucleotide that encodes a 158P3D2-related protein that is at least 90, 91, 92, 93, 94, 95, 96, 97, 98, 99 or 100% identical to an entire amino acid sequence shown in FIG. 2A-Q;

(XXI) a polynucleotide that encodes at least one peptide set forth in Tables VIII-XXI and XXII-XLIX;

(XXII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3A-3R in any whole number increment up to 328, 236, 181, 178, 181, 1393, 1145, 1990, 2036, 610, 1978, and 2018 that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XXIII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3A-3R in any whole number increment up to 328, 236, 181, 178, 181, 1393, 1145, 1990, 2036, 610, 1978, and 2018 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XXIV) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3A-3R in any whole number increment up to 32.8, 236, 181, 178, 181, 1393, 1145, 1990, 2036, 610, 1978, and 2018 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XXV) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3A-3R in any whole number increment up to 328, 236, 181, 178, 181, 1393, 1145, 1990, 2036, 610, 1978, and 2018 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XXVI) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3A-3R in any whole number increment up to 328, 236, 181, 178, 181, 1393, 1145, 1990, 2036, 610, 1978, and 2018 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XXVII) a polynucleotide that is fully complementary to a polynucleotide of any one of (I)-(XXVI);

(XXVIII) a polynucleotide that is fully complementary to a polynucleotide of any one of (I)-(XXVII);

(XXIX) a peptide that is encoded by any of (I) to (XXVIII); and;

(XXX) a composition comprising a polynucleotide of any of (I)-(XXVIII) or peptide of (XXIX) together with a pharmaceutical excipient and/or in a human unit dose form;

(XXXI) a method of using a polynucleotide of any (I)-(XXVIII) or peptide of (XXIX) or a composition of (XXX) in a method to modulate a cell expressing 158P3D2;

(XXXII) a method of using a polynucleotide of any (I)-(XXVIII) or peptide of (XXIX) or a composition of (XXX) in a method to diagnose, prophylax, prognose, or treat an individual who bears a cell expressing 158P3D2;

(XXIII) a method of using a polynucleotide of any (I)-(XXVIII) or peptide of (XXIX) or a composition of (XXX) in a method to diagnose, prophylax, prognose, or treat an individual who bears a cell expressing 158P3D2, said cell from a cancer of a tissue listed in Table I;

(XXXIV) a method of using a polynucleotide of any (I)-(XXVIII) or peptide of (XXIX) or a composition of (XXX) in a method to diagnose, prophylax, prognose, or treat a cancer;

(XXXV) a method of using a polynucleotide of any (I)-(XXVIII) or peptide of (XXIX) or a composition of (XXX) in a method to diagnose, prophylax, prognose, or treat a cancer of a tissue listed in Table I; and;

(XXXVI) a method of using a polynucleotide of any (I)-(XXVIII) or peptide of (XXIX) or a composition of (XXX) in a method to identify or characterize a modulator of a cell expressing 158P3D2.

As used herein, a range is understood to disclose specifically all whole unit positions thereof.

Typical embodiments of the invention disclosed herein include 158P3D2 polynucleotides that encode specific portions of 158P3D2 mRNA sequences (and those which are complementary to such sequences) such as those that encode the proteins and/or fragments thereof, for example:

(a) 4, 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 225, 250, 255, 260, 265, 270, 275, 280, 285, 290, 295, 300, 305, 310, 315, 320, 325 and 328 or more contiguous amino acids of 158P3D2 variant 1; the maximal lengths relevant for other variants are shown in FIGS. 2A-2Q and 3A-3R respectively.

For example, representative embodiments of the invention disclosed herein include: polynucleotides and their encoded peptides themselves encoding about amino acid 1 to about amino acid 10 of the 158P3D2 protein shown in FIG. 2 or FIG. 3, polynucleotides encoding about amino acid 10 to about amino acid 20 of the 158P3D2 protein shown in FIG. 2 or FIG. 3, polynucleotides encoding about amino acid 20 to about amino acid 30 of the 158P3D2 protein shown in FIG. 2 or FIG. 3, polynucleotides encoding about amino acid 30 to about amino acid 40 of the 158P3D2 protein shown in FIG. 2 or FIG. 3, polynucleotides encoding about amino acid 40 to about amino acid 50 of the 158P3D2 protein shown in FIG. 2 or FIG. 3, polynucleotides encoding about amino acid 50 to about amino acid 60 of the 158P3D2 protein shown in FIG. 2 or FIG. 3, polynucleotides encoding about amino acid 60 to about amino acid 70 of the 158P3D2 protein shown in FIG. 2 or FIG. 3, polynucleotides encoding about amino acid 70 to about amino acid 80 of the 158P3D2 protein shown in FIG. 2 or FIG. 3, polynucleotides encoding about amino acid 80 to about amino acid 90 of the 158P3D2 protein shown in FIG. 2 or FIG. 3, polynucleotides encoding about amino acid 90 to about amino acid 100 of the 158P3D2 protein shown in FIG. 2 or FIG. 3, in increments of about 10 amino acids, ending at the carboxyl terminal amino acid set forth in FIG. 2 or FIG. 3.

Accordingly, polynucleotides encoding portions of the amino acid sequence (of about 10 amino acids), of amino acids, 100 through the carboxyl terminal amino acid of the 158P3D2 protein are embodiments of the invention. Wherein it is understood that each particular amino acid position discloses that position plus or minus five amino acid residues.

Polynucleotides encoding relatively long portions of a 158P3D2 protein are also within the scope of the invention. For example, polynucleotides encoding from about amino acid 1 (or 20 or 30 or 40 etc.) to about amino acid 20, (or 30, or 40 or 50 etc.) of the 158P3D2 protein "or variant" shown in FIG. 2 or FIG. 3 can be generated by a variety of techniques well known in the art. These polynucleotide fragments can include any portion of the 158P3D2 sequence as shown in FIG. 2.

Additional illustrative embodiments of the invention disclosed herein include 158P3D2 polynucleotide fragments encoding one or more of the biological motifs contained within a 158P3D2 protein "or variant" sequence, including one or more of the motif-bearing subsequences of a 158P3D2 protein "or variant" set forth in Tables VIII-XXI and XXII-XLIX. In another embodiment, typical polynucleotide fragments of the invention encode one or more of the regions of 158P3D2 protein or variant that exhibit homology to a known molecule. In another embodiment of the invention, typical polynucleotide fragments can encode one or more of the 158P3D2 protein or variant N-glycosylation sites, cAMP and cGMP-dependent protein kinase phosphorylation sites, casein kinase II phosphorylation sites or N-myristoylation site and amidation sites.

Note that to determine the starting position of any peptide set forth in Tables VIII-XXI and Tables XXII to XLIX (collectively HLA Peptide Tables) respective to its parental protein, e.g., variant 1, variant 2, etc., reference is made to three factors: the particular variant, the length of the peptide in an HLA Peptide Table, and the Search Peptides listed in Table VII. Generally, a unique Search Peptide is used to obtain HLA peptides for a particular variant. The position of each Search Peptide relative to its respective parent molecule is listed in Table VII. Accordingly, if a Search Peptide begins at position "X", one must add the value "X minus 1" to each position in Tables VIII-XXI and Tables XXII-IL to obtain the actual position of the HLA peptides in their parental molecule. For example if a particular Search Peptide begins at position 150 of its parental molecule, one must add 150–1, i.e., 149 to each HLA peptide amino acid position to calculate the position of that amino acid in the parent molecule.

II.A.) Uses of 158P3D2 Polynucleotides

II.A.1. Monitoring of Genetic Abnormalities

The polynucleotides of the preceding paragraphs have a number of different specific uses. The human 158P3D2 gene maps to the chromosomal location set forth in the Example entitled "Chromosomal Mapping of 158P3D2." For example, because the 158P3D2 gene maps to this chromosome, polynucleotides that encode different regions of the 158P3D2 proteins are used to characterize cytogenetic abnormalities of this chromosomal locale, such as abnormalities that are identified as being associated with various cancers. In certain genes, a variety of chromosomal abnormalities including rearrangements have been identified as frequent cytogenetic abnormalities in a number of different cancers (see e.g. Krajinovic et al., Mutat. Res. 382(3-4): 81-83 (1998); Johansson et al., Blood 86(10): 3905-3914 (1995) and Finger et al., P.N.A.S. 85(23): 9158-9162 (1988)). Thus, polynucleotides encoding specific regions of the 158P3D2 proteins provide new tools that can be used to delineate, with greater precision than previously possible, cytogenetic abnormalities in the chromosomal region that encodes 158P3D2 that may contribute to the malignant phenotype. In this context, these polynucleotides satisfy a need in the art for expanding the sensitivity of chromosomal screening in order to identify more subtle and less common chromosomal abnormalities (see e.g. Evans et al., Am. J. Obstet. Gynecol 171(4): 1055-1057 (1994)).

Furthermore, as 158P3D2 was shown to be highly expressed in prostate and other cancers, 158P3D2 polynucleotides are used in methods assessing the status of 158P3D2 gene products in normal versus cancerous tissues. Typically, polynucleotides that encode specific regions of the 158P3D2 proteins are used to assess the presence of perturbations (such as deletions, insertions, point mutations, or alterations resulting in a loss of an antigen etc.) in specific regions of the 158P3D2 gene, such as regions containing one or more motifs. Exemplary assays include both RT-PCR assays as well as single-strand conformation polymorphism (SSCP) analysis (see, e.g., Marrogi et al., J. Cutan. Pathol. 26(8): 369-378 (1999), both of which utilize polynucleotides encoding specific regions of a protein to examine these regions within the protein.

II.A.2. Antisense Embodiments

Other specifically contemplated nucleic acid related embodiments of the invention disclosed herein are genomic DNA, cDNAs, ribozymes, and antisense molecules, as well as nucleic acid molecules based on an alternative backbone, or including alternative bases, whether derived from natural sources or synthesized, and include molecules capable of inhibiting the RNA or protein expression of 158P3D2. For example, antisense molecules can be RNAs or other molecules, including peptide nucleic acids (PNAs) or non-nucleic acid molecules such as phosphorothioate derivatives that specifically bind DNA or RNA in a base pair-dependent manner. A skilled artisan can readily obtain these classes of nucleic acid molecules using the 158P3D2 polynucleotides and polynucleotide sequences disclosed herein.

Antisense technology entails the administration of exogenous oligonucleotides that bind to a target polynucleotide located within the cells. The term "antisense" refers to the fact that such oligonucleotides are complementary to their intracellular targets, e.g., 158P3D2. See for example, Jack Cohen, Oligodeoxynucleotides, Antisense Inhibitors of Gene Expression, CRC Press, 1989; and Synthesis 1:1-5 (1988). The 158P3D2 antisense oligonucleotides of the present invention include derivatives such as S-oligonucleotides (phosphorothioate derivatives or S-oligos, see, Jack Cohen, supra), which exhibit enhanced cancer cell growth inhibitory action. S-oligos (nucleoside phosphorothioates) are isoelectronic analogs of an oligonucleotide (O-oligo) in which a nonbridging oxygen atom of the phosphate group is replaced by a sulfur atom. The S-oligos of the present invention can be prepared by treatment of the corresponding O-oligos with 3H-1,2-benzodithiol-3-one-1,1-dioxide, which is a sulfur transfer reagent. See, e.g., Iyer, R. P. et al., J. Org. Chem. 55:4693-4698 (1990); and Iyer, R. P. et al., J. Am. Chem. Soc. 112:1253-1254 (1990). Additional 158P3D2 antisense oligonucleotides of the present invention include morpholino antisense oligonucleotides known in the art (see, e.g., Partridge et al., 1996, Antisense & Nucleic Acid Drug Development 6: 169-175).

The 158P3D2 antisense oligonucleotides of the present invention typically can be RNA or DNA that is complementary to and stably hybridizes with the first 100 5' codons or last 100 3' codons of a 158P3D2 genomic sequence or the corresponding mRNA. Absolute complementarity is not required, although high degrees of complementarity are preferred. Use of an oligonucleotide complementary to this region allows for the selective hybridization to 158P3D2 mRNA and not to mRNA specifying other regulatory subunits of protein kinase. In one embodiment, 158P3D2 antisense oligonucleotides of the present invention are 15 to 30-mer fragments of the antisense DNA molecule that have a sequence that hybridizes to 158P3D2 mRNA. Optionally, 158P3D2 antisense oligonucleotide is a 30-mer oligonucleotide that is complementary to a region in the first 10 5' codons or last 10 3' codons of 158P3D2. Alternatively, the antisense molecules are modified to employ ribozymes in the inhibition of 158P3D2 expression, see, e.g., L. A. Couture & D. T. Stinchcomb; Trends Genet 12: 510-515 (1996).

II.A.3. Primers and Primer Pairs

Further specific embodiments of these nucleotides of the invention include primers and primer pairs, which allow the specific amplification of polynucleotides of the invention or of any specific parts thereof, and probes that selectively or specifically hybridize to nucleic acid molecules of the invention or to any part thereof. Probes can be labeled with a detectable marker, such as, for example, a radioisotope, fluorescent compound, bioluminescent compound, a chemiluminescent compound, metal chelator or enzyme. Such probes and primers are used to detect the presence of a 158P3D2 polynucleotide in a sample and as a means for detecting a cell expressing a 158P3D2 protein.

Examples of such probes include polypeptides comprising all or part of the human 158P3D2 cDNA sequence shown in FIG. 2. Examples of primer pairs capable of specifically amplifying 158P3D2 mRNAs are also described in the Examples. As will be understood by the skilled artisan, a great many different primers and probes can be prepared based on the sequences provided herein and used effectively to amplify and/or detect a 158P3D2 mRNA.

The 158P3D2 polynucleotides of the invention are useful for a variety of purposes, including but not limited to their use as probes and primers for the amplification and/or detection of the 158P3D2 gene(s), mRNA(s), or fragments thereof; as reagents for the diagnosis and/or prognosis of prostate cancer and other cancers; as coding sequences capable of directing the expression of 158P3D2 polypeptides; as tools for modulating or inhibiting the expression of the 158P3D2 gene(s) and/or translation of the 158P3D2 transcript(s); and as therapeutic agents.

The present invention includes the use of any probe as described herein to identify and isolate a 158P3D2 or 158P3D2 related nucleic acid sequence from a naturally occurring source, such as humans or other mammals, as well as the isolated nucleic acid sequence per se, which would comprise all or most of the sequences found in the probe used.

II.A.4. Isolation of 158P3D2-Encoding Nucleic Acid Molecules

The 158P3D2 cDNA sequences described herein enable the isolation of other polynucleotides encoding 158P3D2 gene product(s), as well as the isolation of polynucleotides encoding 158P3D2 gene product homologs, alternatively spliced isoforms, allelic variants, and mutant forms of a 158P3D2 gene product as well as polynucleotides that encode analogs of 158P3D2-related proteins. Various molecular cloning methods that can be employed to isolate full length cDNAs encoding a 158P3D2 gene are well known (see, for example, Sambrook, J. et al., Molecular Cloning: A Laboratory Manual, 2d edition, Cold Spring Harbor Press, New York, 1989; Current Protocols in Molecular Biology. Ausubel et al., Eds., Wiley and Sons, 1995). For example, lambda phage cloning methodologies can be conveniently employed, using commercially available cloning systems (e.g., Lambda ZAP Express, Stratagene). Phage clones containing 158P3D2 gene cDNAs can be identified by probing with a labeled 158P3D2 cDNA or a fragment thereof. For example, in one embodiment, a 158P3D2 cDNA (e.g., FIG. 2) or a portion thereof can be synthesized and used as a probe to retrieve overlapping and full-length cDNAs corresponding to a 158P3D2 gene. A 158P3D2 gene itself can be isolated by screening genomic DNA libraries, bacterial artificial chromosome libraries (BACs), yeast artificial chromosome libraries (YACs), and the like, with 158P3D2 DNA probes or primers.

II.A.5. Recombinant Nucleic Acid Molecules and Host-Vector Systems

The invention also provides recombinant DNA or RNA molecules containing a 158P3D2 polynucleotide, a fragment, analog or homologue thereof, including but not limited to phages, plasmids, phagemids, cosmids, YACs, BACs, as well as various viral and non-viral vectors well known in the art, and cells transformed or transfected with such recombinant DNA or RNA molecules. Methods for generating such molecules are well known (see, for example, Sambrook et al., 1989, supra).

The invention further provides a host-vector system comprising a recombinant DNA molecule containing a 158P3D2 polynucleotide, fragment, analog or homologue thereof within a suitable prokaryotic or eukaryotic host cell. Examples of suitable eukaryotic host cells include a yeast cell, a plant cell, or an animal cell, such as a mammalian cell or an insect cell (e.g., a baculovirus-infectible cell such as an Sf9 or HighFive cell). Examples of suitable mammalian cells include various prostate cancer cell lines such as DU145 and TsuPr1, other transfectable or transducible prostate cancer cell lines, primary cells (PrEC), as well as a number of mammalian cells routinely used for the expression of recombinant proteins (e.g., COS, CHO, 293, 293T cells). More particularly, a polynucleotide comprising the coding sequence of 158P3D2 or a fragment, analog or homolog thereof can be used to generate 158P3D2 proteins or fragments thereof using any number of host-vector systems routinely used and widely known in the art.

A wide range of host-vector systems suitable for the expression of 158P3D2 proteins or fragments thereof are available, see for example, Sambrook et al., 1989, supra; Current Protocols in Molecular Biology, 1995, supra). Preferred vectors for mammalian expression include but are not limited to pcDNA 3.1 myc-His-tag (Invitrogen) and the retroviral vector pSRαtkneo (Muller et al., 1991, MCB 11:1785). Using these expression vectors, 158P3D2 can be expressed in several prostate cancer and non-prostate cell lines, including for example 293, 293T, rat-1, NIH 3T3 and TsuPr1. The host-vector systems of the invention are useful for the production of a 158P3D2 protein or fragment thereof. Such host-vector systems can be employed to study the functional properties of 158P3D2 and 158P3D2 mutations or analogs.

Recombinant human 158P3D2 protein or an analog or homolog or fragment thereof can be produced by mammalian cells transfected with a construct encoding a 158P3D2-related nucleotide. For example, 293T cells can be transfected with an expression plasmid encoding 158P3D2 or fragment, analog or homolog thereof, a 158P3D2-related protein is expressed in the 293T cells, and the recombinant 158P3D2 protein is isolated using standard purification methods (e.g., affinity purification using anti-158P3D2 antibodies). In another embodiment, a 158P3D2 coding sequence is subcloned into the retroviral vector pSRαMSVtkneo and used to infect various mammalian cell lines, such as NIH 3T3, TsuPr1, 293 and rat-1 in order to establish 158P3D2 expressing cell lines. Various other expression systems well known in the art can also be employed. Expression constructs encoding a leader peptide joined in frame to a 158P3D2 coding sequence can be used for the generation of a secreted form of recombinant 158P3D2 protein.

As discussed herein, redundancy in the genetic code permits variation in 158P3D2 gene sequences. In particular, it is known in the art that specific host species often have specific codon preferences, and thus one can adapt the disclosed sequence as preferred for a desired host. For example, preferred analog codon sequences typically have rare codons (i.e., codons having a usage frequency of less than about 20% in known sequences of the desired host) replaced with higher frequency codons. Codon preferences for a specific species are calculated, for example, by utilizing codon usage tables available on the INTERNET such as at URL dna.affrc.go.jp/~nakamura/codon.html.

Additional sequence modifications are known to enhance protein expression in a cellular host. These include elimination of sequences encoding spurious polyadenylation signals, exon/intron splice site signals, transposon-like repeats, and/or other such well-characterized sequences that are deleterious to gene expression. The GC content of the sequence is adjusted to levels average for a given cellular host, as calculated by reference to known genes expressed in the host cell. Where possible, the sequence is modified to avoid predicted hairpin secondary mRNA structures. Other useful modifications include the addition of a translational initiation consensus sequence at the start of the open reading frame, as described in Kozak, Mol. Cell Biol., 9:5073-5080 (1989). Skilled artisans understand that the general rule that eukaryotic ribosomes initiate translation exclusively at the 5' proximal AUG codon is abrogated only under rare conditions (see, e.g., Kozak PNAS 92(7): 2662-2666, (1995) and Kozak NAR 15(20): 8125-8148 (1987)).

III.) 158P3D2-RELATED PROTEINS

Another aspect of the present invention provides 158P3D2-related proteins. Specific embodiments of 158P3D2 proteins comprise a polypeptide having all or part of the amino acid sequence of human 158P3D2 as shown in FIG. 2 or FIG. 3. Alternatively, embodiments of 158P3D2 proteins comprise variant, homolog or analog polypeptides that have alterations in the amino acid sequence of 158P3D2 shown in FIG. 2 or FIG. 3.

Embodiments of a 158P3D2 polypeptide include: a 158P3D2 polypeptide having a sequence shown in FIG. 2, a peptide sequence of a 158P3D2 as shown in FIG. 2 wherein T is U; at least 10 contiguous nucleotides of a polypeptide having the sequence as shown in FIG. 2; or, at least 10 contiguous peptides of a polypeptide having the sequence as shown in FIG. 2 where T is U. For example, embodiments of 158P3D2 peptides comprise, without limitation:

(I) a protein comprising, consisting essentially of, or consisting of an amino acid sequence as shown in FIG. 2A-Q or FIG. 3A-3R;

(II) a 158P3D2-related protein that is at least 90, 91, 92, 93, 94, 95, 96, 97, 98, 99 or 100% homologous to an entire amino acid sequence shown in FIG. 2A-Q or 3A-R;

(III) a 158P3D2-related protein that is at least 90, 91, 92, 93, 94, 95, 96, 97, 98, 99 or 100% identical to an entire amino acid sequence shown in FIG. 2A-Q or 3A-R;

(IV) a protein that comprises at least one peptide set forth in Tables VIII to XLIX, optionally with a proviso that it is not an entire protein of FIG. 2;

(V) a protein that comprises at least one peptide set forth in Tables VIII-XXI, collectively, which peptide is also set forth in Tables XXII to XLIX, collectively, optionally with a proviso that it is not an entire protein of FIG. 2;

(VI) a protein that comprises at least two peptides selected from the peptides set forth in Tables VIII-XLIX, optionally with a proviso that it is not an entire protein of FIG. 2;

(VII) a protein that comprises at least two peptides selected from the peptides set forth in Tables VIII to XLIX collectively, with a proviso that the protein is not a contiguous sequence from an amino acid sequence of FIG. 2;

(VIII) a protein that comprises at least one peptide selected from the peptides set forth in Tables VIII-XXI; and at least one peptide selected from the peptides set forth in Tables XXII to XLIX, with a proviso that the protein is not a contiguous sequence from an amino acid sequence of FIG. 2;

(IX) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3A-3R in any whole number increment up to 328, 236, 181, 178, 1393, 1145, 1990, 2036, 610, 1978, and 2018 respectively that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(X) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3A-3R in any whole number increment up to 328, 236, 181, 178, 1393, 1145, 1990, 2036, 610, 1978, and 2018 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XI) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3A-3R, in any whole number increment up to 328, 236, 181, 178, 1393, 1145, 1990, 2036, 610, 1978, and 2018 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3A-3R, in any whole number increment up to 328, 236, 181, 178, 1393, 1145, 1990, 2036, 610, 1978, and 2018 respectively that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XIII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, amino acids of a protein of FIG. 3A-3R in any whole number increment up to 328, 236, 181, 178, 1393, 1145, 1990, 2036, 610, 1978, and 2018 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XIV) a peptide that occurs at least twice in Tables VIII-XXI and XXII to XLIX, collectively;

(XV) a peptide that occurs at least three times in Tables VIII-XXI and XXII to XLIX, collectively;

(XVI) a peptide that occurs at least four times in Tables VIII-XXI and XXII to XLIX, collectively;

(XVII) a peptide that occurs at least five times in Tables VIII-XXI and XXII to XLIX, collectively;

(XVIII) a peptide that occurs at least once in Tables VIII-XXI, and at least once in tables XXII to XLIX;

(XIX) a peptide that occurs at least once in Tables VIII-XXI, and at least twice in tables XXII to XLIX;

(XX) a peptide that occurs at least twice in Tables VIII-XXI, and at least once in tables XXII to XLIX;

(XXI) a peptide that occurs at least twice in Tables VIII-XXI, and at least twice in tables XXII to XLIX;

(XXII) a peptide which comprises one two, three, four, or five of the following characteristics, or an oligonucleotide encoding such peptide:

i) a region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Hydrophilicity profile of FIG. 5;

ii) a region of at least 5 amino acids of a particular peptide of FIG. 3, in any whole number increment up to the full length of that protein in FIG. 3, that includes an amino acid position having a value equal to or less than 0.5, 0.4, 0.3, 0.2, 0.1, or having a value equal to 0.0, in the Hydropathicity profile of FIG. 6;

iii) a region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Percent Accessible Residues profile of FIG. 7;

iv) a region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Average Flexibility profile of FIG. 8; or, v) a region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Beta-turn profile of FIG. 9;

(XXIII) a composition comprising a peptide of (I)-(XXII) or an antibody or binding region thereof together with a pharmaceutical excipient and/or in a human unit dose form.

(XXIV) a method of using a peptide of (I)-(XXII), or an antibody or binding region thereof or a composition of (XXIII) in a method to modulate a cell expressing 158P3D2;

(XXV) a method of using a peptide of (I)-(XXII) or an antibody or binding region thereof or a composition of (XXIII) in a method to diagnose, prophylax, prognose, or treat an individual who bears a cell expressing 158P3D2;

(XXVI) a method of using a peptide of (I)-(XXII) or an antibody or binding region thereof or a composition (XXIII) in a method to diagnose, prophylax, prognose, or treat an individual who bears a cell expressing 158P3D2, said cell from a cancer of a tissue listed in Table I;

(XXVII) a method of using a peptide of (I)-(XXII) or an antibody or binding region thereof or a composition of (XXIII) in a method to diagnose, prophylax, prognose, or treat a cancer;

(XXVIII) a method of using a peptide of (I)-(XXII) or an antibody or binding region thereof or a composition of (XXIII) in a method to diagnose, prophylax, prognose, or treat a cancer of a tissue listed in Table I;

(XXIX) a method of using a a peptide of (I)-(XXII) or an antibody or binding region thereof or a composition and;

(XXIII) in a method to identify or characterize a modulator of a cell expressing 158P3D2.

As used herein, a range is understood to specifically disclose all whole unit positions thereof.

Typical embodiments of the invention disclosed herein include 158P3D2 polynucleotides that encode specific portions of 158P3D2 mRNA sequences (and those which are complementary to such sequences) such as those that encode the proteins and/or fragments thereof, for example:

(a) 4, 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100, 105, 110, 115, 120, 125, 130, 135, 140, 145; 150, 155, 160, 165, 170, 175, 180, 185, 190, 195, 200, 225, 250, 255, 260, 265, 270, 275, 280, 285, 290, 295, 300, 305, 310, 315, 320, 325, and 328 or more contiguous amino acids of 158P3D2 variant 1; the maximal lengths relevant for other variants are shown in FIGS. 2A-2Q and 3A-3R.

In general, naturally occurring allelic variants of human 158P3D2 share a high degree of structural identity and homology (e.g., 90% or more homology). Typically, allelic variants of a 158P3D2 protein contain conservative amino acid substitutions within the 158P3D2 sequences described herein or contain a substitution of an amino acid from a corresponding position in a homologue of 158P3D2. One class of 158P3D2 allelic variants are proteins that share a high degree of homology with at least a small region of a particular 158P3D2 amino acid sequence, but further contain a radical departure from the sequence, such as a non-conservative substitution, truncation, insertion or frame shift. In comparisons of protein sequences, the terms, similarity, identity, and homology each have a distinct meaning as appreciated in the field of genetics. Moreover, orthology and paralogy can be important concepts describing the relationship of members of a given protein family in one organism to the members of the same family in other organisms.

Amino acid abbreviations are provided in Table II. Conservative amino acid substitutions can frequently be made in a protein without altering either the conformation or the function of the protein. Proteins of the invention can comprise 1, 2, 3, 4, 5, 6, 7, 8, 9, 10, 11, 12, 13, 14, 15 conservative substitutions. Such changes include substituting any of isoleucine (I), valine (V), and leucine (L) for any other of these hydrophobic amino acids; aspartic acid (D) for glutamic acid (E) and vice versa; glutamine (Q) for asparagine (N) and vice versa; and serine (S) for threonine (T) and vice versa. Other substitutions can also be considered conservative, depending on the environment of the particular amino acid and its role in the three-dimensional structure of the protein. For example, glycine (G) and alanine (A) can frequently be interchangeable, as can alanine (A) and valine (V). Methionine (M), which is relatively hydrophobic, can frequently be interchanged with leucine and isoleucine, and sometimes with valine. Lysine (K) and arginine (R) are frequently interchangeable in locations in which the significant feature of the amino acid residue is its charge and the differing pK's of these two amino acid residues are not significant. Still other changes can be considered "conservative" in particular environments (see, e.g. Table III herein; pages 13-15 "Biochemistry" 2nd ED. Lubert Stryer ed (Stanford University); Henikoff et al., PNAS 1992 Vol 89 10915-10919; Lei et al., J Biol Chem 1995 May 19; 270(20):11882-6).

Embodiments of the invention disclosed herein include a wide variety of art-accepted variants or analogs of 158P3D2 proteins such as polypeptides having amino acid insertions, deletions and substitutions. 158P3D2 variants can be made using methods known in the art such as site-directed mutagenesis, alanine scanning, and PCR mutagenesis. Site-directed mutagenesis (Carter et al., Nucl. Acids Res., 13:4331 (1986); Zoller et al., Nucl. Acids Res., 10:6487 (1987)), cassette mutagenesis (Wells et al., Gene, 34:315 (1985)), restriction selection mutagenesis (Wells et al., Philos. Trans. R. Soc. London SerA, 317:415 (1986)) or other known techniques can be performed on the cloned DNA to produce the 158P3D2 variant DNA.

Scanning amino acid analysis can also be employed to identify one or more amino acids along a contiguous sequence that is involved in a specific biological activity such as a protein-protein interaction. Among the preferred scanning amino acids are relatively small, neutral amino acids. Such amino acids include alanine, glycine, serine, and cysteine. Alanine is typically a preferred scanning amino acid among this group because it eliminates the side-chain beyond the beta-carbon and is less likely to alter the main-chain conformation of the variant. Alanine is also typically preferred because it is the most common amino acid. Further, it is frequently found in both buried and exposed positions (Creighton, The Proteins, (W.H. Freeman & Co., N.Y.); Chothia, J. Mol. Biol., 150:1 (1976)). If alanine substitution does not yield adequate amounts of variant, an isosteric amino acid can be used.

As defined herein, 158P3D2 variants, analogs or homologs, have the distinguishing attribute of having at least one epitope that is "cross reactive" with a 158P3D2 protein having an amino acid sequence of FIG. 3. As used in this sentence, "cross reactive" means that an antibody or T cell that specifically binds to a 158P3D2 variant also specifically binds to a 158P3D2 protein having an amino acid sequence set forth in FIG. 3. A polypeptide ceases to be a variant of a protein shown in FIG. 3, when it no longer contains any epitope capable of being recognized by an antibody or T cell that specifically binds to the starting 158P3D2 protein. Those skilled in the art understand that antibodies that recognize proteins bind to epitopes of varying size, and a grouping of the order of about four or five amino acids, contiguous or not, is regarded as a typical number of amino acids in a minimal epitope. See, e.g., Nair et al., J. Immunol 2000 165(12): 6949-6955; Hebbes et al., Mol Immunol (1989) 26(9):865-73; Schwartz et al., J Immunol (1985) 135(4):2598-608.

Other classes of 158P3D2-related protein variants share 70%, 75%, 80%, 85% or 90% or more similarity with an amino acid sequence of FIG. 3, or a fragment thereof. Another specific class of 158P3D2 protein variants or analogs comprises one or more of the 158P3D2 biological motifs described herein or presently known in the art. Thus, encompassed by the present invention are analogs of 158P3D2 fragments (nucleic or amino acid) that have altered functional (e.g. immunogenic) properties relative to the starting fragment. It is to be appreciated that motifs now or which become part of the art are to be applied to the nucleic or amino acid sequences of FIG. 2 or FIG. 3.

As discussed herein, embodiments of the claimed invention include polypeptides containing less than the full amino acid sequence of a 158P3D2 protein shown in FIG. 2 or FIG. 3. For example, representative embodiments of the invention comprise peptides/proteins having any 4, 5, 6, 7, 8, 9, 10, 11, 12, 13, 14, 15 or more contiguous amino acids of a 158P3D2 protein shown in FIG. 2 or FIG. 3.

Moreover, representative embodiments of the invention disclosed herein include polypeptides consisting of about amino acid 1 to about amino acid 10 of a 158P3D2 protein shown in FIG. 2 or FIG. 3, polypeptides consisting of about amino acid 10 to about amino acid 20 of a 158P3D2 protein shown in FIG. 2 or FIG. 3, polypeptides consisting of about amino acid 20 to about amino acid 30 of a 158P3D2 protein shown in FIG. 2 or FIG. 3, polypeptides consisting of about amino acid 30 to about amino acid 40 of a 158P3D2 protein shown in FIG. 2 or FIG. 3, polypeptides consisting of about amino acid 40 to about amino acid 50 of a 158P3D2 protein shown in FIG. 2 or FIG. 3, polypeptides consisting of about amino acid 50 to about amino acid 60 of a 158P3D2 protein shown in FIG. 2 or FIG. 3, polypeptides consisting of about amino acid 60 to about amino acid 70 of a 158P3D2 protein shown in FIG. 2 or FIG. 3, polypeptides consisting of about amino acid 70 to about amino acid 80 of a 158P3D2 protein shown in FIG. 2 or FIG. 3, polypeptides consisting of about amino acid 80 to about amino acid 90 of a 158P3D2 protein shown in FIG. 2 or FIG. 3, polypeptides consisting of about amino acid 90 to about amino acid 100 of a 158P3D2 protein shown in FIG. 2 or FIG. 3, etc. throughout the entirety of a 158P3D2 amino acid sequence. Moreover, polypeptides consisting of about amino acid 1 (or 20 or 30 or 40 etc.) to about amino acid 20, (or 130, or 140 or 150 etc.) of a 158P3D2 protein shown in FIG. 2 or FIG. 3 are embodiments of the invention. It is to be appreciated that the starting and stopping positions in this paragraph refer to the specified position as well as that position plus or minus 5 residues.

158P3D2-related proteins are generated using standard peptide synthesis technology or using chemical cleavage methods well known in the art. Alternatively, recombinant methods can be used to generate nucleic acid molecules that encode a 158P3D2-related protein. In one embodiment, nucleic acid molecules provide a means to generate defined fragments of a 158P3D2 protein (or variants, homologs or analogs thereof).

III.A.) Motif-Bearing Protein Embodiments

Additional illustrative embodiments of the invention disclosed herein include 158P3D2 polypeptides comprising the amino acid residues of one or more of the biological motifs contained within a 158P3D2 polypeptide sequence set forth in FIG. 2 or FIG. 3. Various motifs are known in the art, and a protein can be evaluated for the presence of such motifs by a number of publicly available Internet sites (see, e.g., URL addresses: pfam.wustl.edu/; searchlauncher.bcm.tmc.edu/seq-search/struc-predict.html; psort.ims.u-tokyo.acjp/; cbs.dtu.dk/; ebi.ac.uk/interpro/scan.html; expasy.ch/tools/scnpsit1.html; Epimatrix™ and Epimer™, Brown University, brown.edu/Research/TB-HIV_Lab/epimatrix/epimatrix.html; and BIMAS, bimas.dcrt.nih.gov/.).

Motif bearing subsequences of all 158P3D2 variant proteins are set forth and identified in Tables VIII-XXI and XXII-XLIX.

Table V sets forth several frequently occurring motifs based on pfam searches (see URL address pfam.wustl.edu/). The columns of Table V list (1) motif name abbreviation, (2) percent identity found amongst the different member of the motif family, (3) motif name or description and (4) most common function; location information is included if the motif is relevant for location.

Polypeptides comprising one or more of the 158P3D2 motifs discussed above are useful in elucidating the specific characteristics of a malignant phenotype in view of the observation that the 158P3D2 motifs discussed above are associated with growth dysregulation and because 158P3D2 is overexpressed in certain cancers (See, e.g., Table I). Casein kinase II, cAMP and camp-dependent protein kinase, and Protein Kinase C, for example, are enzymes known to be associated with the development of the malignant phenotype (see e.g.

Chen et al., Lab Invest., 78(2): 165-174 (1998); Gaiddon et al., Endocrinology 136(10): 4331-4338 (1995); Hall et al., Nucleic Acids Research 24(6): 1119-1126 (1996); Peterziel et al., Oncogene 18(46): 6322-6329 (1999) and O'Brian, Oncol. Rep. 5(2): 305-309 (1998)). Moreover, both glycosylation and myristoylation are protein modifications also associated with cancer and cancer progression (see e.g. Dennis et al., Biochem. Biophys. Acta 1473(1):21-34 (1999); Raju et al., Exp. Cell Res. 235(1): 145-154 (1997)). Amidation is another protein modification also associated with cancer and cancer progression (see e.g. Treston et al., J. Natl. Cancer Inst. Monogr. (13): 169-175 (1992)).

In another embodiment, proteins of the invention comprise one or more of the immunoreactive epitopes identified in accordance with art-accepted methods, such as the peptides set forth in Tables VIII-XXI and XXII-XLIX. CTL epitopes can be determined using specific algorithms to identify peptides within a 158P3D2 protein that are capable of optimally binding to specified HLA alleles (e.g., Table IV; Epimatrix™ and Epimer™, Brown University, URL brown.edu/Research/TB-HIV_Lab/epimatrix/epimatrix.html; and BIMAS, URL bimas.dcrt.nih.gov/.) Moreover, processes for identifying peptides that have sufficient binding affinity for HLA molecules and which are correlated with being immunogenic epitopes, are well known in the art, and are carried out without undue experimentation. In addition, processes for identifying peptides that are immunogenic epitopes, are well known in the art, and are carried out without undue experimentation either in vitro or in vivo.

Also known in the art are principles for creating analogs of such epitopes in order to modulate immunogenicity. For example, one begins with an epitope that bears a CTL or HTL motif (see, e.g., the HLA Class I and HLA Class II motifs/supermotifs of Table IV). The epitope is analoged by substituting out an amino acid at one of the specified positions, and replacing it with another amino acid specified for that position. For example, on the basis of residues defined in Table IV, one can substitute out a deleterious residue in favor of any other residue, such as a preferred residue; substitute a less-preferred residue with a preferred residue; or substitute an originally-occurring preferred residue with another preferred residue. Substitutions can occur at primary anchor positions or at other positions in a peptide; see, e.g., Table IV.

A variety of references reflect the art regarding the identification and generation of epitopes in a protein of interest as well as analogs thereof. See, for example, WO 97/33602 to Chesnut et al.; Sette, Immunogenetics 1999 50(3-4): 201-212; Sette et al., J. Immunol. 2001 166(2): 1389-1397; Sidney et al., Hum. Immunol. 1997 58(1): 12-20; Kondo et al., Immunogenetics 1997 45(4): 249-258; Sidney et al., J. Immunol. 1996 157(8): 3480-90; and Falk et al., Nature 351: 290-6 (1991); Hunt et al., Science 255:1261-3 (1992); Parker et al., J. Immunol. 149:3580-7 (1992); Parker et al., J. Immunol. 152:163-75 (1994)); Kast et al., 1994 152(8): 3904-12; Borras-Cuesta et al., Hum. Immunol. 2000 61(3): 266-278; Alexander et al., J. Immunol. 2000 164(3); 164(3): 1625-1633; Alexander et al., PMID: 7895164, UI: 95202582; O'Sullivan et al., J. Immunol. 1991 147(8): 2663-2669; Alexander et al., Immunity 1994 1(9): 751-761 and Alexander et al., Immunol. Res. 1998 18(2): 79-92.

Related embodiments of the invention include polypeptides comprising combinations of the different motifs set forth in Table VI, and/or, one or more of the predicted CTL epitopes of Tables VIII-XXI and XXII-XLIX, and/or, one or more of the predicted HTL epitopes of Tables XLVI-XLIX, and/or, one or more of the T cell binding motifs known in the art. Preferred embodiments contain no insertions, deletions or substitutions either within the motifs or within the intervening sequences of the polypeptides. In addition, embodiments which include a number of either N-terminal and/or C-terminal amino acid residues on either side of these motifs may be desirable (to, for example, include a greater portion of the polypeptide architecture in which the motif is located). Typically, the number of N-terminal and/or C-terminal amino acid residues on either side of a motif is between about 1 to about 100 amino acid residues, preferably 5 to about 50 amino acid residues.

158P3D2-related proteins are embodied in many forms, preferably in isolated form. A purified 158P3D2 protein molecule will be substantially free of other proteins or molecules that impair the binding of 158P3D2 to antibody, T cell or other ligand. The nature and degree of isolation and purification will depend on the intended use. Embodiments of a 158P3D2-related proteins include purified 158P3D2-related proteins and functional, soluble 158P3D2-related proteins. In one embodiment, a functional, soluble 158P3D2 protein or fragment thereof retains the ability to be bound by antibody, T cell or other ligand.

The invention also provides 158P3D2 proteins comprising biologically active fragments of a 158P3D2 amino acid sequence shown in FIG. 2 or FIG. 3. Such proteins exhibit properties of the starting 158P3D2 protein, such as the ability to elicit the generation of antibodies that specifically bind an epitope associated with the starting 158P3D2 protein; to be bound by such antibodies; to elicit the activation of HTL or CTL; and/or, to be recognized by HTL or CTL that also specifically bind to the starting protein.

158P3D2-related polypeptides that contain particularly interesting structures can be predicted and/or identified using various analytical techniques well known in the art, including, for example, the methods of Chou-Fasman, Garnier-Robson, Kyte-Doolittle, Eisenberg, Karplus-Schultz or Jameson-Wolf analysis, or based on immunogenicity. Fragments that contain such structures are particularly useful in generating subunit-specific anti-158P3D2 antibodies or T cells or in identifying cellular factors that bind to 158P3D2. For example, hydrophilicity profiles can be generated, and immunogenic peptide fragments identified, using the method of Hopp, T. P. and Woods, K. R., 1981, Proc. Natl. Acad. Sci. U.S.A. 78:3824-3828. Hydropathicity profiles can be generated, and immunogenic peptide fragments identified, using the method of Kyte, J. and Doolittle, R. F., 1982, J. Mol. Biol. 157:105-132. Percent (%) Accessible Residues profiles can be generated, and immunogenic peptide fragments identified, using the method of Janin J., 1979, Nature 277:491-492. Average Flexibility profiles can be generated, and immunogenic peptide fragments identified, using the method of Bhaskaran R., Ponnuswamy P. K., 1988, Int. J. Pept. Protein Res. 32:242-255. Beta-turn profiles can be generated, and immunogenic peptide fragments identified, using the method of Deleage, G., Roux B., 1987, Protein Engineering 1:289-294.

CTL epitopes can be determined using specific algorithms to identify peptides within a 158P3D2 protein that are capable of optimally binding to specified HLA alleles (e.g., by using the SYFPEITHI site at World Wide Web URL syfpeithi.bmi-heidelberg.com/; the listings in Table IV(A)-(E); Epimatrix™ and Epimer™, Brown University, URL (brown.edu/Research/TB-HIV_Lab/epimatrix/epimatrix.html); and BIMAS, URL bimas.dcrt.nih.gov/). Illustrating this, peptide epitopes from 158P3D2 that are presented in the context of human MHC Class I molecules, e.g., HLA-A1, A2, A3, A11, A24, B7 and B35 were predicted (see, e.g., Tables VIII-XXI, XXII-XLIX). Specifically, the complete amino acid sequence of the 158P3D2 protein and relevant portions of other variants, i.e., for HLA Class I predictions 9 flanking residues on either side of a point mutation or exon junction, and for HLA Class II predictions 14 flanking residues on either side of a point mutation or exon junction corresponding to that variant, were entered into the HLA Peptide Motif Search algorithm found in the Bioinformatics and Molecular Analysis Section (BIMAS) web site listed above; in addition to the site SYFPEITHI, at URL syfpeithi.bmi-heidelberg.com/.

The HLA peptide motif search algorithm was developed by Dr. Ken Parker based on binding of specific peptide sequences in the groove of HLA Class I molecules, in particular HLA-A2 (see, e.g., Falk et al., Nature 351: 290-6 (1991); Hunt et al., Science 255:1261-3 (1992); Parker et al., J. Immunol. 149:3580-7 (1992); Parker et al., J. Immunol. 152:163-75 (1994)). This algorithm allows location and ranking of 8-mer, 9-mer, and 10-mer peptides from a complete protein sequence for predicted binding to HLA-A2 as well as numerous other HLA Class I molecules. Many HLA class I binding peptides are 8-, 9-, 10 or 11-mers. For example, for Class I HLA-A2, the epitopes preferably contain a leucine (L) or methionine (M) at position 2 and a valine (V) or leucine (L) at the C-terminus (see, e.g., Parker et al., J. Immunol. 149: 3580-7 (1992)). Selected results of 158P3D2 predicted binding peptides are shown in Tables VIII-XXI and XXII-XLIX herein. In Tables VIII-XXI and XXII-XLVII, selected candidates, 9-mers and 10-mers, for each family member are shown along with their location, the amino acid sequence of each specific peptide, and an estimated binding score. In Tables XLVI-XLIX, selected candidates, 15-mers, for each family member are shown along with their location, the amino acid sequence of each specific peptide, and an estimated binding score. The binding score corresponds to the estimated half time of dissociation of complexes containing the peptide at 37° C. at pH 6.5. Peptides with the highest binding score are predicted to be the most tightly bound to HLA Class I on the cell surface for the greatest period of time and thus represent the best immunogenic targets for T-cell recognition.

Actual binding of peptides to an HLA allele can be evaluated by stabilization of HLA expression on the antigen-processing defective cell line T2 (see, e.g., Xue et al., Prostate 30:73-8 (1997) and Peshwa et al., Prostate 36:129-38 (1998)). Immunogenicity of specific peptides can be evaluated in vitro by stimulation of CD8+ cytotoxic T lymphocytes (CTL) in the presence of antigen presenting cells such as dendritic cells.

It is to be appreciated that every epitope predicted by the BIMAS site, Epimer™ and Epimatrix™ sites, or specified by the HLA class I or class II motifs available in the art or which become part of the art such as set forth in Table IV (or determined using World Wide Web site URL syfpeithi.bmi-heidelberg.com/, or BIMAS, bimas.dcrt.nih.gov/) are to be "applied" to a 158P3D2 protein in accordance with the invention. As used in this context "applied" means that a 158P3D2 protein is evaluated, e.g., visually or by computer-based patterns finding methods, as appreciated by those of skill in the relevant art. Every subsequence of a 158P3D2 protein of 8, 9, 10, or 11 amino acid residues that bears an HLA Class I motif, or a subsequence of 9 or more amino acid residues that bear an HLA Class II motif are within the scope of the invention.

III.B.) Expression of 158P3D2-Related Proteins

In an embodiment described in the examples that follow, 158P3D2 can be conveniently expressed in cells (such as 293T cells) transfected with a commercially available expression vector such as a CMV-driven expression vector encoding 158P3D2 with a C-terminal 6× His and MYC tag (pcDNA3.1/ mycHIS, Invitrogen or Tag5, GenHunter Corporation, Nashville Tenn.). The Tag5 vector provides an IgGK secretion signal that can be used to facilitate the production of a secreted 158P3D2 protein in transfected cells. The secreted HIS-tagged 158P3D2 in the culture media can be purified, e.g., using a nickel column using standard techniques.

III.C.) Modifications of 158P3D2-Related Proteins

Modifications of 158P3D2-related proteins such as covalent modifications are included within the scope of this invention. One type of covalent modification includes reacting targeted amino acid residues of a 158P3D2 polypeptide with an organic derivatizing agent that is capable of reacting with selected side chains or the N- or C-terminal residues of a 158P3D2 protein. Another type of covalent modification of a 158P3D2 polypeptide included within the scope of this invention comprises altering the native glycosylation pattern of a protein of the invention. Another type of covalent modification of 158P3D2 comprises linking a 158P3D2 polypeptide to one of a variety of nonproteinaceous polymers, e.g., polyethylene glycol (PEG), polypropylene glycol, or polyoxyalkylenes, in the manner set forth in U.S. Pat. Nos. 4,640,835; 4,496,689; 4,301,144; 4,670,417; 4,791,192 or 4,179,337.

The 158P3D2-related proteins of the present invention can also be modified to form a chimeric molecule comprising 158P3D2 fused to another, heterologous polypeptide or amino acid sequence. Such a chimeric molecule can be synthesized chemically or recombinantly. A chimeric molecule can have a protein of the invention fused to another tumor-associated antigen or fragment thereof. Alternatively, a protein in accordance with the invention can comprise a fusion of fragments of a 158P3D2 sequence (amino or nucleic acid) such that a molecule is created that is not, through its length, directly homologous to the amino or nucleic acid sequences shown in FIG. 2 or FIG. 3. Such a chimeric molecule can comprise multiples of the same subsequence of 158P3D2. A chimeric molecule can comprise a fusion of a 158P3D2-related protein with a polyhistidine epitope tag, which provides an epitope to which immobilized nickel can selectively bind, with cytokines or with growth factors. The epitope tag is generally placed at the amino- or carboxyl-terminus of a 158P3D2 protein. In an alternative embodiment, the chimeric molecule can comprise a fusion of a 158P3D2-related protein with an immunoglobulin or a particular region of an immunoglobulin. For a bivalent form of the chimeric molecule (also referred to as an "immunoadhesin"), such a fusion could be to the Fc region of an IgG molecule. The Ig fusions preferably include the substitution of a soluble (transmembrane domain deleted or inactivated) form of a 158P3D2 polypeptide in place of at least one variable region within an Ig molecule. In a preferred embodiment, the immunoglobulin fusion includes the hinge, CH2 and CH3, or the hinge, CH1, CH2 and CH3 regions of an IgGI molecule. For the production of immunoglobulin fusions see, e.g., U.S. Pat. No. 5,428, 130 issued Jun. 27, 1995.

III.D.) Uses of 158P3D2-Related Proteins

The proteins of the invention have a number of different specific uses. As 158P3D2 is highly expressed in prostate and other cancers, 158P3D2-related proteins are used in methods that assess the status of 158P3D2 gene products in normal versus cancerous tissues, thereby elucidating the malignant phenotype. Typically, polypeptides from specific regions of a 158P3D2 protein are used to assess the presence of perturbations (such as deletions, insertions, point mutations etc.) in those regions (such as regions containing one or more motifs). Exemplary assays utilize antibodies or T cells targeting 158P3D2-related proteins comprising the amino acid residues of one or more of the biological motifs contained within a 158P3D2 polypeptide sequence in order to evaluate the characteristics of this region in normal versus cancerous tissues or to elicit an immune response to the epitope. Alternatively, 158P3D2-related proteins that contain the amino acid residues of one or more of the biological motifs in a 158P3D2 protein are used to screen for factors that interact with that region of 158P3D2.

158P3D2 protein fragments/subsequences are particularly useful in generating and characterizing domain-specific antibodies (e.g., antibodies recognizing an extracellular or intracellular epitope of a 158P3D2 protein), for identifying agents or cellular factors that bind to 158P3D2 or a particular structural domain thereof, and in various therapeutic and diagnostic contexts, including but not limited to diagnostic assays, cancer vaccines and methods of preparing such vaccines.

Proteins encoded by the 158P3D2 genes, or by analogs, homologs or fragments thereof, have a variety of uses, including but not limited to generating antibodies and in methods for identifying ligands and other agents and cellular constituents that bind to a 158P3D2 gene product. Antibodies raised against a 158P3D2 protein or fragment thereof are useful in diagnostic and prognostic assays, and imaging methodologies in the management of human cancers characterized by expression of 158P3D2 protein, such as those listed in Table I. Such antibodies can be expressed intracellularly and used in methods of treating patients with such cancers. 158P3D2-related nucleic acids or proteins are also used in generating HTL or CTL responses.

Various immunological assays useful for the detection of 158P3D2 proteins are used, including but not limited to various types of radioimmunoassays, enzyme-linked immunosorbent assays (ELISA), enzyme-linked immunofluorescent assays (ELIFA), immunocytochemical methods, and the like. Antibodies can be labeled and used as immunological imaging reagents capable of detecting 158P3D2-expressing cells (e.g., in radioscintigraphic imaging methods). 158P3D2 proteins are also particularly useful in generating cancer vaccines, as further described herein.

IV.) 158P3D2 ANTIBODIES

Another aspect of the invention provides antibodies that bind to 158P3D2-related proteins. Preferred antibodies specifically bind to a 158P3D2-related protein and do not bind (or bind weakly) to peptides or proteins that are not 158P3D2-related proteins under physiological conditions. In this context, examples of physiological conditions include: 1) phosphate buffered saline; 2) Tris-buffered saline containing 25 mM Tris and 150 mM NaCl; or normal saline (0.9% NaCl); 4) animal serum such as human serum; or, 5) a combination of any of 1) through 4); these reactions preferably taking place at pH 7.5, alternatively in a range of pH 7.0 to 8.0, or alternatively in a range of pH 6.5 to 8.5; also, these reactions taking place at a temperature between 4° C. to 37° C. For example, antibodies that bind 158P3D2 can bind 158P3D2-related proteins such as the homologs or analogs thereof.

158P3D2 antibodies of the invention are particularly useful in cancer (see, e.g., Table I) diagnostic and prognostic assays, and imaging methodologies. Similarly, such antibodies are useful in the treatment, diagnosis, and/or prognosis of other cancers, to the extent 158P3D2 is also expressed or overexpressed in these other cancers. Moreover, intracellularly expressed antibodies (e.g., single chain antibodies) are therapeutically useful in treating cancers in which the expression of 158P3D2 is involved, such as advanced or metastatic prostate cancers.

The invention also provides various immunological assays useful for the detection and quantification of 158P3D2 and mutant 158P3D2-related proteins. Such assays can comprise one or more 158P3D2 antibodies capable of recognizing and binding a 158P3D2-related protein, as appropriate. These assays are performed within various immunological assay formats well known in the art, including but not limited to various types of radioimmunoassays, enzyme-linked immunosorbent assays (ELISA), enzyme-linked immunofluorescent assays (ELIFA), and the like.

Immunological non-antibody assays of the invention also comprise T cell immunogenicity assays (inhibitory or stimulatory) as well as major histocompatibility complex (MHC) binding assays.

In addition, immunological imaging methods capable of detecting prostate cancer and other cancers expressing 158P3D2 are also provided by the invention, including but not limited to radioscintigraphic imaging methods using labeled 158P3D2 antibodies. Such assays are clinically useful in the detection, monitoring, and prognosis of 158P3D2 expressing cancers such as prostate cancer.

158P3D2 antibodies are also used in methods for purifying a 158P3D2-related protein and for isolating 158P3D2 homologues and related molecules. For example, a method of purifying a 158P3D2-related protein comprises incubating a 158P3D2 antibody, which has been coupled to a solid matrix, with a lysate or other solution containing a 158P3D2-related protein under conditions that permit the 158P3D2 antibody to bind to the 158P3D2-related protein; washing the solid matrix to eliminate impurities; and eluting the 158P3D2-related protein from the coupled antibody. Other uses of 158P3D2 antibodies in accordance with the invention include generating anti-idiotypic antibodies that mimic a 158P3D2 protein.

Various methods for the preparation of antibodies are well known in the art. For example, antibodies can be prepared by immunizing a suitable mammalian host using a 158P3D2-related protein, peptide, or fragment, in isolated or immunoconjugated form (Antibodies: A Laboratory Manual, CSH Press, Eds., Harlow, and Lane (1988); Harlow, Antibodies, Cold Spring Harbor Press, NY (1989)). In addition, fusion proteins of 158P3D2 can also be used, such as a 158P3D2 GST-fusion protein. In a particular embodiment, a GST fusion protein comprising all or most of the amino acid sequence of FIG. 2 or FIG. 3 is produced, then used as an immunogen to generate appropriate antibodies. In another embodiment, a 158P3D2-related protein is synthesized and used as an immunogen.

In addition, naked DNA immunization techniques known in the art are used (with or without purified 158P3D2-related protein or 158P3D2 expressing cells) to generate an immune response to the encoded immunogen (for review, see Donnelly et al., 1997, Ann. Rev. Immunol. 15: 617-648).

The amino acid sequence of a 158P3D2 protein as shown in FIG. 2 or FIG. 3 can be analyzed to select specific regions of the 158P3D2 protein for generating antibodies. For example, hydrophobicity and hydrophilicity analyses of a 158P3D2 amino acid sequence are used to identify hydrophilic regions in the 158P3D2 structure. Regions of a 158P3D2 protein that show immunogenic structure, as well as other regions and domains, can readily be identified using various other methods known in the art, such as Chou-Fasman, Garnier-Robson, Kyte-Doolittle, Eisenberg, Karplus-Schultz or Jameson-Wolf analysis. Hydrophilicity profiles can be generated using the method of Hopp, T. P. and Woods, K. R., 1981, Proc. Natl. Acad. Sci. U.S.A. 78:3824-3828. Hydropathicity profiles can be generated using the method of Kyte, J. and Doolittle, R. F., 1982, J. Mol. Biol. 157:105-132. Percent (%) Accessible Residues profiles can be generated using the method of Janin J., 1979, Nature 277:491-492. Average Flexibility profiles can be generated using the method of Bhaskaran R., Ponnuswamy P. K., 1988, Int. J. Pept. Protein Res. 32:242-255. Beta-turn profiles can be generated using the method of Deleage, G., Roux B., 1987, Protein Engineering 1:289-294. Thus, each region identified by any of these programs or methods is within the scope of the present invention. Methods for the generation of 158P3D2 antibodies are further illustrated by way of the examples provided herein. Methods for preparing a protein or polypeptide for use as an immunogen are well known in the art. Also well known in the art are methods for preparing immunogenic conjugates of a protein with a carrier, such as BSA, KLH or other carrier protein. In some circumstances, direct conjugation using, for example, carbodiimide reagents are used; in other instances linking reagents such as those supplied by Pierce Chemical Co., Rockford, Ill., are effective. Administration of a 158P3D2 immunogen is often conducted by injection over a suitable time period and with use of a suitable adjuvant, as is understood in the art. During the immunization schedule, titers of antibodies can be taken to determine adequacy of antibody formation.

158P3D2 monoclonal antibodies can be produced by various means well known in the art. For example, immortalized cell lines that secrete a desired monoclonal antibody are prepared using the standard hybridoma technology of Kohler and Milstein or modifications that immortalize antibody-producing B cells, as is generally known. Immortalized cell lines that secrete the desired antibodies are screened by immunoassay in which the antigen is a 158P3D2-related protein. When the appropriate immortalized cell culture is identified, the cells can be expanded and antibodies produced either from in vitro cultures or from ascites fluid.

The antibodies or fragments of the invention can also be produced, by recombinant means. Regions that bind specifically to the desired regions of a 158P3D2 protein can also be produced in the context of chimeric or complementarity-determining region (CDR) grafted antibodies of multiple species origin. Humanized or human 158P3D2 antibodies can also be produced, and are preferred for use in therapeutic contexts. Methods for humanizing murine and other non-human antibodies, by substituting one or more of the non-human antibody CDRs for corresponding human antibody sequences, are well known (see for example, Jones et al., 1986, Nature 321: 522-525; Riechmann et al., 1988, Nature 332: 323-327; Verhoeyen et al., 1988, Science 239: 1534-1536). See also, Carter et al., 1993, Proc. Natl. Acad. Sci. USA 89: 4285 and Sims et al., 1993, J. Immunol. 151: 2296.

Methods for producing fully human monoclonal antibodies include phage display and transgenic methods (for review, see Vaughan et al., 1998, Nature Biotechnology 16: 535-539). Fully human 158P3D2 monoclonal antibodies can be generated using cloning technologies employing large human Ig gene combinatorial libraries (i.e., phage display) (Griffiths and Hoogenboom, Building an in vitro immune system: human antibodies from phage display libraries. In: Protein Engineering of Antibody Molecules for Prophylactic and Therapeutic Applications in Man, Clark, M. (Ed.), Nottingham Academic, pp 45-64 (1993); Burton and Barbas, Human Antibodies from combinatorial libraries. Id., pp 65-82). Fully human 158P3D2 monoclonal antibodies can also be produced using transgenic mice engineered to contain human immunoglobulin gene loci as described in PCT Patent Application WO98/24893, Kucherlapati and Jakobovits et al., published Dec. 3, 1997 (see also, Jakobovits, 1998, Exp. Opin. Invest. Drugs 7(4): 607-614; U.S. Pat. No. 6,162,963 issued 19 Dec. 2000; U.S. Pat. No. 6,150,584 issued 12 Nov. 2000; and, U.S. Pat. No. 6,114,598 issued 5 Sep. 2000). This method avoids the in vitro manipulation required with phage display technology and efficiently produces high affinity authentic human antibodies.

Reactivity of 158P3D2 antibodies with a 158P3D2-related protein can be established by a number of well known means, including Western blot, immunoprecipitation, ELISA, and FACS analyses using, as appropriate, 158P3D2-related proteins, 158P3D2-expressing cells or extracts thereof. A 158P3D2 antibody or fragment thereof can be labeled with a detectable marker or conjugated to a second molecule. Suitable detectable markers include, but are not limited to, a radioisotope, a fluorescent compound, a bioluminescent compound, chemiluminescent compound, a metal chelator or an enzyme. Further, bi-specific antibodies specific for two or more 158P3D2 epitopes are generated using methods generally known in the art. Homodimeric antibodies can also be generated by cross-linking techniques known in the art (e.g., Wolff et al., Cancer Res. 53: 2560-2565).

V.) 158P3D2 CELLULAR IMMUNE RESPONSES

The mechanism by which T cells recognize antigens has been delineated. Efficacious peptide epitope vaccine compositions of the invention induce a therapeutic or prophylactic immune responses in very broad segments of the world-wide population. For an understanding of the value and efficacy of compositions of the invention that induce cellular immune responses, a brief review of immunology-related technology is provided.

A complex of an HLA molecule and a peptidic antigen acts as the ligand recognized by HLA-restricted T cells (Buus, S. et al., Cell 47:1071, 1986; Babbitt, B. P. et al., Nature 317: 359, 1985; Townsend, A. and Bodmer, H., Annu. Rev. Immunol. 7:601, 1989; Germain, R. N., Annu. Rev. Immunol. 11:403, 1993). Through the study of single amino acid substituted antigen analogs and the sequencing of endogenously bound, naturally processed peptides, critical residues that correspond to motifs required for specific binding to HLA antigen molecules have been identified and are set forth in Table IV (see also, e.g., Southwood, et al., J. Immunol. 160: 3363, 1998; Rammensee, et al., Immunogenetics 41:178, 1995; Rammensee et al., SYFPEITHI, access via World Wide Web at URL (134.2.96.221/scripts.hlaserver.dll/home.htm); Sette, A. and Sidney, J. Curr. Opin. Immunol. 10:478, 1998; Engelhard, V. H., Curr. Opin. Immunol. 6:13, 1994; Sette, A. and Grey, H. M., Curr. Opin. Immunol. 4:79, 1992; Sinigaglia, F. and Hammer, J. Curr. Biol. 6:52, 1994; Ruppert et al., Cell 74:929-937, 1993; Kondo et al., J. Immunol. 155: 4307-4312, 1995; Sidney et al., J. Immunol. 157:3480-3490, 1996; Sidney et al., Human Immunol. 45:79-93, 1996; Sette, A. and Sidney, J. Immunogenetics 1999 November; 50(3-4): 201-12, Review).

Furthermore, x-ray crystallographic analyses of HLA-peptide complexes have revealed pockets within the peptide binding cleft/groove of HLA molecules which accommodate, in an allele-specific mode, residues borne by peptide ligands; these residues in turn determine the HLA binding capacity of the peptides in which they are present. (See, e.g., Madden, D. R. Annu. Rev. Immunol. 13:587, 1995; Smith, et al., Immunity 4:203, 1996; Fremont et al., Immunity 8:305, 1998; Stern et al., Structure 2:245, 1994; Jones, E. Y. Curr. Opin. Immunol. 9:75, 1997; Brown, J. H. et al., Nature 364:33, 1993; Guo, H. C. et al., Proc. Natl. Acad. Sci. USA 90:8053, 1993; Guo, H. C. et al., Nature 360:364, 1992; Silver, M. L. et al., Nature 360:367, 1992; Matsumura, M. et al., Science 257:927, 1992; Madden et al., Cell 70:1035, 1992; Fremont, D. H. et al., Science 257:919, 1992; Saper, M. A., Bjorkman, P. J. and Wiley, D. C., J. Mol. Biol. 219:277, 1991.)

Accordingly, the definition of class I and class II allele-specific HLA binding motifs, or class I or class II supermotifs allows identification of regions within a protein that are correlated with binding to particular HLA antigen(s).

Thus, by a process of HLA motif identification, candidates for epitope-based vaccines have been identified; such candidates can be further evaluated by HLA-peptide binding assays to determine binding affinity and/or the time period of association of the epitope and its corresponding HLA molecule. Additional confirmatory work can be performed to select, amongst these vaccine candidates, epitopes with preferred characteristics in terms of population coverage, and/or immunogenicity.

Various strategies can be utilized to evaluate cellular immunogenicity, including:

1) Evaluation of primary T cell cultures from normal individuals (see, e.g., Wentworth, P. A. et al., Mol. Immunol. 32:603, 1995; Celis, E. et al., Proc. Natl. Acad. Sci. USA 91:2105, 1994; Tsai, V. et al., J. Immunol. 158:1796, 1997; Kawashima, I. et al., Human Immunol. 59:1, 1998). This procedure involves the stimulation of peripheral blood lymphocytes (PBL) from normal subjects with a test peptide in the presence of antigen presenting cells in vitro over a period of several weeks. T cells specific for the peptide become activated during this time and are detected using, e.g., a lymphokine- or 51Cr-release assay involving peptide sensitized target cells.

2) Immunization of HLA transgenic mice (see, e.g., Wentworth, P. A. et al., J. Immunol. 26:97, 1996; Wentworth, P. A. et al., Int. Immunol. 8:651, 1996; Alexander, J. et al., J. Immunol. 159:4753, 1997). For example, in such methods peptides in incomplete Freund's adjuvant are administered subcutaneously to HLA transgenic mice. Several weeks following immunization, splenocytes are removed and cultured in vitro in the presence of test peptide for approximately one week. Peptide-specific T cells are detected using, e.g., a 51Cr-release assay involving peptide sensitized target cells and target cells expressing endogenously generated antigen.

3) Demonstration of recall T cell responses from immune individuals who have been either effectively vaccinated and/or from chronically ill patients (see, e.g., Rehermann, B. et al., J. Exp. Med. 181:1047, 1995; Doolan, D. L. et al., Immunity 7:97, 1997; Bertoni, R. et al., J. Clin. Invest. 100:503, 1997; Threlkeld, S. C. et al., J. Immunol. 159:1648, 1997; Diepolder, H. M. et al., J. Virol. 71:6011, 1997). Accordingly, recall responses are detected by culturing PBL from subjects that have been exposed to the antigen due to disease and thus have generated an immune response "naturally", or from patients who were vaccinated against the antigen. PBL from subjects are cultured in vitro for 1-2 weeks in the presence of test peptide plus antigen presenting cells (APC) to allow activation of "memory" T cells, as compared to "naive" T cells. At the end of the culture period, T cell activity is detected using assays including 51 Cr release involving peptide-sensitized targets, T cell proliferation, or lymphokine release.

VI.) 158P3D2 TRANSGENIC ANIMALS

Nucleic acids that encode a 158P3D2-related protein can also be used to generate either transgenic animals or "knock out" animals that, in turn, are useful in the development and screening of therapeutically useful reagents. In accordance with established techniques, cDNA encoding 158P3D2 can be used to clone genomic DNA that encodes 158P3D2. The cloned genomic sequences can then be used to generate transgenic animals containing cells that express DNA that encode 158P3D2. Methods for generating transgenic animals, particularly animals such as mice or rats, have become conventional in the art and are described, for example, in U.S. Pat. No. 4,736,866 issued 12 Apr. 1988, and U.S. Pat. No. 4,870,009 issued 26 Sep. 1989. Typically, particular cells would be targeted for 158P3D2 transgene incorporation with tissue-specific enhancers.

Transgenic animals that include a copy of a transgene encoding 158P3D2 can be used to examine the effect of increased expression of DNA that encodes 158P3D2. Such animals can be used as tester animals for reagents thought to confer protection from, for example, pathological conditions associated with its overexpression. In accordance with this aspect of the invention, an animal is treated with a reagent and a reduced incidence of a pathological condition, compared to untreated animals that bear the transgene, would indicate a potential therapeutic intervention for the pathological condition.

Alternatively, non-human homologues of 158P3D2 can be used to construct a 158P3D2 "knock out" animal that has a defective or altered gene encoding 158P3D2 as a result of homologous recombination between the endogenous gene encoding 158P3D2 and altered genomic DNA encoding 158P3D2 introduced into an embryonic cell of the animal. For example, cDNA that encodes 158P3D2 can be used to clone genomic DNA encoding 158P3D2 in accordance with established techniques. A portion of the genomic DNA encoding 158P3D2 can be deleted or replaced with another gene, such as a gene encoding a selectable marker that can be used to monitor integration. Typically, several kilobases of unaltered flanking DNA (both at the 5' and 3' ends) are included in the vector (see, e.g., Thomas and Capecchi, Cell, 51:503 (1987) for a description of homologous recombination vectors). The vector is introduced into an embryonic stem cell line (e.g., by electroporation) and cells in which the introduced DNA has homologously recombined with the endogenous DNA are selected (see, e.g., Li et al., Cell, 69:915 (1992)). The selected cells are then injected into a blastocyst of an animal (e.g., a mouse or rat) to form aggregation chimeras (see, e.g., Bradley, in Teratocarcinomas and Embryonic Stem Cells: A Practical Approach, E. J. Robertson, ed. (IRL, Oxford, 1987), pp. 113-152). A chimeric embryo can then be implanted into a suitable pseudopregnant female foster animal, and the embryo brought to term to create a "knock out" animal. Progeny harboring the homologously recombined DNA in their germ cells can be identified by standard techniques and used to breed animals in which all cells of the animal contain the homologously recombined DNA. Knock out animals can be characterized, for example, for their ability to defend against certain pathological conditions or for their development of pathological conditions due to absence of a 158P3D2 polypeptide.

VII.) METHODS FOR THE DETECTION OF 158P3D2

Another aspect of the present invention relates to methods for detecting 158P3D2 polynucleotides and 158P3D2-related proteins, as well as methods for identifying a cell that expresses 158P3D2. The expression profile of 158P3D2 makes it a diagnostic marker for metastasized disease. Accordingly, the status of 158P3D2 gene products provides information useful for predicting a variety of factors including susceptibility to advanced stage disease, rate of progression, and/or tumor aggressiveness. As discussed in detail herein, the status of 158P3D2 gene products in patient samples can be analyzed by a variety protocols that are well known in the art including immunohistochemical analysis, the variety of Northern blotting techniques including in situ hybridization, RT-PCR analysis (for example on laser capture micro-dissected samples), Western blot analysis and tissue array analysis.

More particularly, the invention provides assays for the detection of 158P3D2 polynucleotides in a biological sample, such as serum, bone, prostate, and other tissues, urine, semen, cell preparations, and the like. Detectable 158P3D2 polynucleotides include, for example, a 158P3D2 gene or fragment thereof, 158P3D2 mRNA, alternative splice variant 158P3D2 mRNAs, and recombinant DNA or RNA molecules that contain a 158P3D2 polynucleotide. A number of methods for amplifying and/or detecting the presence of 158P3D2 polynucleotides are well known in the art and can be employed in the practice of this aspect of the invention.

In one embodiment, a method for detecting a 158P3D2 mRNA in a biological sample comprises producing cDNA from the sample by reverse transcription using at least one primer; amplifying the cDNA so produced using a 158P3D2 polynucleotides as sense and antisense primers to amplify 158P3D2 cDNAs therein; and detecting the presence of the amplified 158P3D2 cDNA. Optionally, the sequence of the amplified 158P3D2 cDNA can be determined.

In another embodiment, a method of detecting a 158P3D2 gene in a biological sample comprises first isolating genomic DNA from the sample; amplifying the isolated genomic DNA using 158P3D2 polynucleotides as sense and antisense primers; and detecting the presence of the amplified 158P3D2 gene. Any number of appropriate sense and antisense probe combinations can be designed from a 158P3D2 nucleotide sequence (see, e.g., FIG. 2) and used for this purpose.

The invention also provides assays for detecting the presence of a 158P3D2 protein in a tissue or other biological sample such as serum, semen, bone, prostate, urine, cell preparations, and the like. Methods for detecting a 158P3D2-related protein are also well known and include, for example, immunoprecipitation, immunohistochemical analysis, Western blot analysis, molecular binding assays, ELISA, ELIFA and the like. For example, a method of detecting the presence of a 158P3D2-related protein in a biological sample comprises first contacting the sample with a 158P3D2 antibody, a 158P3D2-reactive fragment thereof, or a recombinant protein containing an antigen-binding region of a 158P3D2 antibody; and then detecting the binding of 158P3D2-related protein in the sample.

Methods for identifying a cell that expresses 158P3D2 are also within the scope of the invention. In one embodiment, an assay for identifying a cell that expresses a 158P3D2 gene comprises detecting the presence of 158P3D2 mRNA in the cell. Methods for the detection of particular mRNAs in cells are well known and include, for example, hybridization assays using complementary DNA probes (such as in situ hybridization using labeled 158P3D2 riboprobes, Northern blot and related techniques) and various nucleic acid amplification assays (such as RT-PCR using complementary primers specific for 158P3D2, and other amplification type detection methods, such as, for example, branched DNA, SISBA, TMA and the like). Alternatively, an assay for identifying a cell that expresses a 158P3D2 gene comprises detecting the presence of 158P3D2-related protein in the cell or secreted by the cell. Various methods for the detection of proteins are well known in the art and are employed for the detection of 158P3D2-related proteins and cells that express 158P3D2-related proteins.

158P3D2 expression analysis is also useful as a tool for identifying and evaluating agents that modulate 158P3D2 gene expression. For example, 158P3D2 expression is significantly upregulated in prostate cancer, and is expressed in cancers of the tissues listed in Table I. Identification of a molecule or biological agent that inhibits 158P3D2 expression or over-expression in cancer cells is of therapeutic value. For example, such an agent can be identified by using a screen that quantifies 158P3D2 expression by RT-PCR, nucleic acid hybridization or antibody binding.

VIII.) METHODS FOR MONITORING THE STATUS OF 158P3D2-RELATED GENES AND THEIR PRODUCTS

Oncogenesis is known to be a multistep process where cellular growth becomes progressively dysregulated and cells progress from a normal physiological state to precancerous and then cancerous states (see, e.g., Alers et al., Lab Invest. 77(5): 437-438 (1997) and Isaacs et al., Cancer Surv. 23: 19-32 (1995)). In this context, examining a biological sample for evidence of dysregulated cell growth (such as aberrant 158P3D2 expression in cancers) allows for early detection of such aberrant physiology, before a pathologic state such as cancer has progressed to a stage that therapeutic options are more limited and or the prognosis is worse. In such examinations, the status of 158P3D2 in a biological sample of interest can be compared, for example, to the status of 158P3D2 in a corresponding normal sample (e.g. a sample from that individual or alternatively another individual that is not affected by a pathology). An alteration in the status of 158P3D2 in the biological sample (as compared to the normal sample) provides evidence of dysregulated cellular growth. In addition to using a biological sample that is not affected by a pathology as a normal sample, one can also use a predetermined normative value such as a predetermined normal level of mRNA expression (see, e.g., Grever et al., J. Comp. Neurol. 1996 Dec. 9; 376(2): 306-14 and U.S. Pat. No. 5,837,501) to compare 158P3D2 status in a sample.

The term "status" in this context is used according to its art accepted meaning and refers to the condition or state of a gene and its products. Typically, skilled artisans use a number of parameters to evaluate the condition or state of a gene and its products. These include, but are not limited to the location of expressed gene products (including the location of 158P3D2 expressing cells) as well as the level, and biological activity of expressed gene products (such as 158P3D2 mRNA, polynucleotides and polypeptides). Typically, an alteration in the status of 158P3D2 comprises a change in the location of 158P3D2 and/or 158P3D2 expressing cells and/or an increase in 158P3D2 mRNA and/or protein expression.

158P3D2 status in a sample can be analyzed by a number of means well known in the art, including without limitation, immunohistochemical analysis, in situ hybridization, RT-PCR analysis on laser capture micro-dissected samples, Western blot analysis, and tissue array analysis. Typical protocols for evaluating the status of a 158P3D2 gene and gene products are found, for example in Ausubel et al. eds., 1995, Current Protocols In Molecular Biology, Units 2 (Northern Blotting), 4 (Southern Blotting), 15 (Immunoblotting) and 18 (PCR Analysis). Thus, the status of 158P3D2 in a biological sample is evaluated by various methods utilized by skilled artisans including, but not limited to genomic Southern analysis (to examine, for example perturbations in a 158P3D2 gene), Northern analysis and/or PCR analysis of 158P3D2 mRNA (to examine, for example alterations in the polynucleotide sequences or expression levels of 158P3D2 mRNAs), and, Western and/or immunohistochemical analysis (to examine, for example alterations in polypeptide sequences, alterations in polypeptide localization within a sample, alterations in expression levels of 158P3D2 proteins and/or associations of 158P3D2 proteins with polypeptide binding partners). Detectable 158P3D2 polynucleotides include, for example, a 158P3D2 gene or fragment thereof, 158P3D2 mRNA, alternative splice variants, 158P3D2 mRNAs, and recombinant DNA or RNA molecules containing a 158P3D2 polynucleotide.

The expression profile of 158P3D2 makes it a diagnostic marker for local and/or metastasized disease, and provides information on the growth or oncogenic potential of a biological sample. In particular, the status of 158P3D2 provides information useful for predicting susceptibility to particular disease stages, progression, and/or tumor aggressiveness. The invention provides methods and assays for determining 158P3D2 status and diagnosing cancers that express 158P3D2, such as cancers of the tissues listed in Table I. For example, because 158P3D2 mRNA is so highly expressed in prostate and other cancers relative to normal prostate tissue, assays that evaluate the levels of 158P3D2 mRNA transcripts or proteins in a biological sample can be used to diagnose a disease associated with 158P3D2 dysregulation, and can provide prognostic information useful in defining appropriate therapeutic options.

The expression status of 158P3D2 provides information including the presence, stage and location of dysplastic, precancerous and cancerous cells, predicting susceptibility to various stages of disease, and/or for gauging tumor aggressiveness. Moreover, the expression profile makes it useful as an imaging reagent for metastasized disease. Consequently, an aspect of the invention is directed to the various molecular prognostic and diagnostic methods for examining the status of 158P3D2 in biological samples such as those from individuals suffering from, or suspected of suffering from a pathology characterized by dysregulated cellular growth, such as cancer.

As described above, the status of 158P3D2 in a biological sample can be examined by a number of well-known procedures in the art. For example, the status of 158P3D2 in a biological sample taken from a specific location in the body can be examined by evaluating the sample for the presence or absence of 158P3D2 expressing cells (e.g. those that express 158P3D2 mRNAs or proteins). This examination can provide evidence of dysregulated cellular growth, for example, when 158P3D2-expressing cells are found in a biological sample that does not normally contain such cells (such as a lymph node), because such alterations in the status of 158P3D2 in a biological sample are often associated with dysregulated cellular growth. Specifically, one indicator of dysregulated cellular growth is the metastases of cancer cells from an organ of origin (such as the prostate) to a different area of the body (such as a lymph node). In this context, evidence of dysregulated cellular growth is important for example because occult lymph node metastases can be detected in a substantial proportion of patients with prostate cancer, and such metastases are associated with known predictors of disease progression (see, e.g., Murphy et al., Prostate 42(4): 315-317 (2000);Su et al., Semin. Surg. Oncol. 18(1): 17-28 (2000) and Freeman et al., J Urol 1995 August 154(2 Pt 1):474-8).

In one aspect, the invention provides methods for monitoring 158P3D2 gene products by determining the status of 158P3D2 gene products expressed by cells from an individual suspected of having a disease associated with dysregulated cell growth (such as hyperplasia or cancer) and then comparing the status so determined to the status of 158P3D2 gene products in a corresponding normal sample. The presence of aberrant 158P3D2 gene products in the test sample relative to the normal sample provides an indication of the presence of dysregulated cell growth within the cells of the individual.

In another aspect, the invention provides assays useful in determining the presence of cancer in an individual, comprising detecting a significant increase in 158P3D2 mRNA or protein expression in a test cell or tissue sample relative to expression levels in the corresponding normal cell or tissue. The presence of 158P3D2 mRNA can, for example, be evaluated in tissues including but not limited to those listed in Table I. The presence of significant 158P3D2 expression in any of these tissues is useful to indicate the emergence, presence and/or severity of a cancer, since the corresponding normal tissues do not express 158P3D2 mRNA or express it at lower levels.

In a related embodiment, 158P3D2 status is determined at the protein level rather than at the nucleic acid level. For example, such a method comprises determining the level of 158P3D2 protein expressed by cells in a test tissue sample and comparing the level so determined to the level of 158P3D2 expressed in a corresponding normal sample. In one embodiment, the presence of 158P3D2 protein is evaluated, for example, using immunohistochemical methods. 158P3D2 antibodies or binding partners capable of detecting 158P3D2 protein expression are used in a variety of assay formats well known in the art for this purpose.

In a further embodiment, one can evaluate the status of 158P3D2 nucleotide and amino acid sequences in a biological sample in order to identify perturbations in the structure of these molecules. These perturbations can include insertions, deletions, substitutions and the like. Such evaluations are useful because perturbations in the nucleotide and amino acid sequences are observed in a large number of proteins associated with a growth dysregulated phenotype (see, e.g., Marrogi et al., 1999, J. Cutan. Pathol. 26(8):369-378). For example, a mutation in the sequence of 158P3D2 may be indicative of the presence or promotion of a tumor. Such assays therefore have diagnostic and predictive value where a mutation in 158P3D2 indicates a potential loss of function or increase in tumor growth.

A wide variety of assays for observing perturbations in nucleotide and amino acid sequences are well known in the art. For example, the size and structure of nucleic acid or amino acid sequences of 158P3D2 gene products are observed by the Northern, Southern, Western, PCR and DNA sequencing protocols discussed herein. In addition, other methods for observing perturbations in nucleotide and amino acid sequences such as single strand conformation polymorphism analysis are well known in the art (see, e.g., U.S. Pat. No. 5,382,510 issued 7 Sep. 1999, and U.S. Pat. No. 5,952, 170 issued 17 Jan. 1995).

Additionally, one can examine the methylation status of a 158P3D2 gene in a biological sample. Aberrant demethylation and/or hypermethylation of CpG islands in gene 5' regulatory regions frequently occurs in immortalized and transformed cells, and can result in altered expression of various genes. For example, promoter hypermethylation of the pi-class glutathione S-transferase (a protein expressed in normal prostate but not expressed in >90% of prostate carcinomas) appears to permanently silence transcription of this gene and is the most frequently detected genomic alteration in prostate carcinomas (De Marzo et al., Am. J. Pathol. 155(6): 1985-1992 (1999)). In addition, this alteration is present in at least 70% of cases of high-grade prostatic intraepithelial neoplasia (PIN) (Brooks et al., Cancer Epidemiol. Biomarkers Prev., 1998, 7:531-536). In another example, expression of the LAGE-I tumor specific gene (which is not expressed in normal prostate but is expressed in 25-50% of prostate cancers) is induced by deoxy-azacytidine in lymphoblastoid cells, suggesting that tumoral expression is due to demethylation (Lethe et al., Int. J. Cancer 76(6): 903-908 (1998)). A variety of assays for examining methylation status of a gene are well known in the art. For example, one can utilize, in Southern hybridization approaches, methylation-sensitive restriction enzymes that cannot cleave sequences that contain methylated CpG sites to assess the methylation status of CpG islands. In addition, MSP (methylation specific PCR) can rapidly profile the methylation status of all the CpG sites present in a CpG island of a given gene. This procedure involves initial modification of DNA by sodium bisulfite (which will convert all unmethylated cytosines to uracil) followed by amplification using primers specific for methylated versus unmethylated DNA. Protocols involving methylation interference can also be found for example in Current Protocols In Molecular Biology, Unit 12, Frederick M. Ausubel et al. eds., 1995.

Gene amplification is an additional method for assessing the status of 158P3D2. Gene amplification is measured in a sample directly, for example, by conventional Southern blotting or Northern blotting to quantitate the transcription of mRNA (Thomas, 1980, Proc. Natl. Acad. Sci. USA, 77:5201-5205), dot blotting (DNA analysis), or in situ hybridization, using an appropriately labeled probe, based on the sequences provided herein. Alternatively, antibodies are employed that recognize specific duplexes, including DNA duplexes, RNA duplexes, and DNA-RNA hybrid duplexes or DNA-protein duplexes. The antibodies in turn are labeled and the assay carried out where the duplex is bound to a surface, so that upon the formation of duplex on the surface, the presence of antibody bound to the duplex can be detected.

Biopsied tissue or peripheral blood can be conveniently assayed for the presence of cancer cells using for example, Northern, dot blot or RT-PCR analysis to detect 158P3D2 expression. The presence of RT-PCR amplifiable 158P3D2 mRNA provides an indication of the presence of cancer. RT-PCR assays are well known in the art. RT-PCR detection assays for tumor cells in peripheral blood are currently being evaluated for use in the diagnosis and management of a number of human solid tumors. In the prostate cancer field, these include RT-PCR assays for the detection of cells expressing PSA and PSM (Verkaik et al., 1997, Urol. Res. 25:373-384; Ghossein et al., 1995, J. Clin. Oncol. 13:1195-2000; Heston et al., 1995, Clin. Chem. 41:1687-1688).

A further aspect of the invention is an assessment of the susceptibility that an individual has for developing cancer. In one embodiment, a method for predicting susceptibility to cancer comprises detecting 158P3D2 mRNA or 158P3D2 protein in a tissue sample, its presence indicating susceptibility to cancer, wherein the degree of 158P3D2 mRNA expression correlates to the degree of susceptibility. In a specific embodiment, the presence of 158P3D2 in prostate or other tissue is examined, with the presence of 158P3D2 in the sample providing an indication of prostate cancer susceptibility (or the emergence or existence of a prostate tumor). Similarly, one can evaluate the integrity 158P3D2 nucleotide and amino acid sequences in a biological sample, in order to identify perturbations in the structure of these molecules such as insertions, deletions, substitutions and the like. The presence of one or more perturbations in 158P3D2 gene products in the sample is an indication of cancer susceptibility (or the emergence or existence of a tumor).

The invention also comprises methods for gauging tumor aggressiveness. In one embodiment, a method for gauging aggressiveness of a tumor comprises determining the level of 158P3D2 mRNA or 158P3D2 protein expressed by tumor cells, comparing the level so determined to the level of 158P3D2 mRNA or 158P3D2 protein expressed in a corresponding normal tissue taken from the same individual or a normal tissue reference sample, wherein the degree of 158P3D2 mRNA or 158P3D2 protein expression in the tumor sample relative to the normal sample indicates the degree of aggressiveness. In a specific embodiment, aggressiveness of a tumor is evaluated by determining the extent to which 158P3D2 is expressed in the tumor cells, with higher expression levels indicating more aggressive tumors. Another embodiment is the evaluation of the integrity of 158P3D2 nucleotide and amino acid sequences in a biological sample, in order to identify perturbations in the structure of these molecules such as insertions, deletions, substitutions and the like. The presence of one or more perturbations indicates more aggressive tumors.

Another embodiment of the invention is directed to methods for observing the progression of a malignancy in an individual over time. In one embodiment, methods for observing the progression of a malignancy in an individual over time comprise determining the level of 158P3D2 mRNA or 158P3D2 protein expressed by cells in a sample of the tumor, comparing the level so determined to the level of 158P3D2 mRNA or 158P3D2 protein expressed in an equivalent tissue sample taken from the same individual at a different time, wherein the degree of 158P3D2 mRNA or 158P3D2 protein expression in the tumor sample over time provides information on the progression of the cancer. In a specific embodiment, the progression of a cancer is evaluated by determining 158P3D2 expression in the tumor cells over time, where increased expression over time indicates a progression of the cancer. Also, one can evaluate the integrity 158P3D2 nucleotide and amino acid sequences in a biological sample in order to identify perturbations in the structure of these molecules such as insertions, deletions, substitutions and the like, where the presence of one or more perturbations indicates a progression of the cancer.

The above diagnostic approaches can be combined with any one of a wide variety of prognostic and diagnostic protocols known in the art. For example, another embodiment of the invention is directed to methods for observing a coincidence between the expression of 158P3D2 gene and 158P3D2 gene products (or perturbations in 158P3D2 gene and 158P3D2 gene products) and a factor that is associated with malignancy, as a means for diagnosing and prognosticating the status of a tissue sample. A wide variety of factors associated with malignancy can be utilized, such as the expression of genes associated with malignancy (e.g. PSA, PSCA and PSM expression for prostate cancer etc.) as well as gross cytological observations (see, e.g., Bocking et al., 1984, Anal. Quant. Cytol. 6(2):74-88; Epstein, 1995, Hum. Pathol. 26(2):223-9; Thorson et al., 1998, Mod. Pathol. 11(6):543-51; Baisden et al., 1999, Am. J. Surg. Pathol. 23(8):918-24). Methods for observing a coincidence between the expression of 158P3D2 gene and 158P3D2 gene products (or perturbations in 158P3D2 gene and 158P3D2 gene products) and another factor that is associated with malignancy are useful, for example, because the presence of a set of specific factors that coincide with disease provides information crucial for diagnosing and prognosticating the status of a tissue sample.

In one embodiment, methods for observing a coincidence between the expression of 158P3D2 gene and 158P3D2 gene products (or perturbations in 158P3D2 gene and 158P3D2 gene products) and another factor associated with malignancy entails detecting the overexpression of 158P3D2 mRNA or protein in a tissue sample, detecting the overexpression of PSA mRNA or protein in a tissue sample (or PSCA or PSM expression), and observing a coincidence of 158P3D2 mRNA or protein and PSA mRNA or protein overexpression (or PSCA or PSM expression). In a specific embodiment, the expression of 158P3D2 and PSA mRNA in prostate tissue is examined, where the coincidence of 158P3D2 and PSA mRNA overexpression in the sample indicates the existence of prostate cancer, prostate cancer susceptibility or the emergence or status of a prostate tumor.

Methods for detecting and quantifying the expression of 158P3D2 mRNA or protein are described herein, and standard nucleic acid and protein detection and quantification technologies are well known in the art. Standard methods for the detection and quantification of 158P3D2 mRNA include in situ hybridization using labeled 158P3D2 riboprobes, Northern blot and related techniques using 158P3D2 polynucleotide probes, RT-PCR analysis using primers specific for 158P3D2, and other amplification type detection methods, such as, for example, branched DNA, SISBA, TMA and the like. In a specific embodiment, semi-quantitative RT-PCR is used to detect and quantify 158P3D2 mRNA expression. Any number of primers capable of amplifying 158P3D2 can be used for this purpose, including but not limited to the various primer sets specifically described herein. In a specific embodiment, polyclonal or monoclonal antibodies specifically reactive with the wild-type 158P3D2 protein can be used in an immunohistochemical assay of biopsied tissue.

IX.) IDENTIFICATION OF MOLECULES THAT INTERACT WITH 158P3D2

The 158P3D2 protein and nucleic acid sequences disclosed herein allow a skilled artisan to identify proteins, small molecules and other agents that interact with 158P3D2, as well as pathways activated by 158P3D2 via any one of a variety of art accepted protocols. For example, one can utilize one of the so-called interaction trap systems (also referred to as the "two-hybrid assay"). In such systems, molecules interact and reconstitute a transcription factor which directs expression of a reporter gene, whereupon the expression of the reporter gene is assayed. Other systems identify protein-protein interactions in vivo through reconstitution of a eukaryotic transcriptional activator, see, e.g., U.S. Pat. No. 5,955,280 issued 21 Sep. 1999, U.S. Pat. No. 5,925,523 issued 20 Jul. 1999, U.S. Pat. No. 5,846,722 issued 8 Dec. 1998 and U.S. Pat. No. 6,004,746 issued 21 Dec. 1999. Algorithms are also available in the art for genome-based predictions of protein function (see, e.g., Marcotte, et al., Nature 402: 4 Nov. 1999, 83-86).

Alternatively one can screen peptide libraries to identify molecules that interact with 158P3D2 protein sequences. In such methods, peptides that bind to 158P3D2 are identified by screening libraries that encode a random or controlled collection of amino acids. Peptides encoded by the libraries are expressed as fusion proteins of bacteriophage coat proteins, the bacteriophage particles are then screened against the 158P3D2 protein(s).

Accordingly, peptides having a wide variety of uses, such as therapeutic, prognostic or diagnostic reagents, are thus identified without any prior information on the structure of the expected ligand or receptor molecule. Typical peptide libraries and screening methods that can be used to identify molecules that interact with 158P3D2 protein sequences are disclosed for example in U.S. Pat. No. 5,723,286 issued 3 Mar. 1998 and U.S. Pat. No. 5,733,731 issued 31 Mar. 1998.

Alternatively, cell lines that express 158P3D2 are used to identify protein-protein interactions mediated by 158P3D2. Such interactions can be examined using immunoprecipitation techniques (see, e.g., Hamilton B. J., et al. Biochem. Biophys. Res. Commun. 1999, 261:646-51). 158P3D2 protein can be immunoprecipitated from 158P3D2-expressing cell lines using anti-158P3D2 antibodies. Alternatively, antibodies against His-tag can be used in a cell line engineered to express fusions of 158P3D2 and a His-tag (vectors mentioned above). The immunoprecipitated complex can be examined for protein association by procedures such as Western blotting, 35S-methionine labeling of proteins, protein microsequencing, silver staining and two-dimensional gel electrophoresis.

Small molecules and ligands that interact with 158P3D2 can be identified through related embodiments of such screening assays. For example, small molecules can be identified that interfere with protein function, including molecules that interfere with 158P3D2's ability to mediate phosphorylation and de-phosphorylation, interaction with DNA or RNA molecules as an indication of regulation of cell cycles, second messenger signaling or tumorigenesis. Similarly, small molecules that modulate 158P3D2-related ion channel, protein pump, or cell communication functions are identified and used to treat patients that have a cancer that expresses 158P3D2 (see, e.g., Hille, B., Ionic Channels of Excitable Membranes 2nd Ed., Sinauer Assoc., Sunderland, Mass., 1992). Moreover, ligands that regulate 158P3D2 function can be identified based on their ability to bind 158P3D2 and activate a reporter construct. Typical methods are discussed for example in U.S. Pat. No. 5,928,868 issued 27 Jul. 1999, and include methods for forming hybrid ligands in which at least one ligand is a small molecule. In an illustrative embodiment, cells engineered to express a fusion protein of 158P3D2 and a DNA-binding protein are used to co-express a fusion protein of a hybrid ligand/small molecule and a cDNA library transcriptional activator protein. The cells further contain a reporter gene, the expression of which is conditioned on the proximity of the first and second fusion proteins to each other, an event that occurs only if the hybrid ligand binds to target sites on both hybrid proteins. Those cells that express the reporter gene are selected and the unknown small molecule or the unknown ligand is identified. This method provides a means of identifying modulators, which activate or inhibit 158P3D2.

An embodiment of this invention comprises a method of screening for a molecule that interacts with a 158P3 D2 amino acid sequence shown in FIG. 2 or FIG. 3, comprising the steps of contacting a population of molecules with a 158P3D2 amino acid sequence, allowing the population of molecules and the 158P3D2 amino acid sequence to interact under conditions that facilitate an interaction, determining the presence of a molecule that interacts with the 158P3D2 amino acid sequence, and then separating molecules that do not interact with the 158P3D2 amino acid sequence from molecules that do. In a specific embodiment, the method further comprises purifying, characterizing and identifying a molecule that interacts with the 158P3D2 amino acid sequence. The identified molecule can be used to modulate a function performed by 158P3D2. In a preferred embodiment, the 158P3D2 amino acid sequence is contacted with a library of peptides.

X.) THERAPEUTIC METHODS AND COMPOSITIONS

The identification of 158P3D2 as a protein that is normally expressed in a restricted set of tissues, but which is also expressed in cancers such as those listed in Table I, opens a number of therapeutic approaches to the treatment of such cancers.

Of note, targeted antitumor therapies have been useful even when the targeted protein is expressed on normal tissues, even vital normal organ tissues. A vital organ is one that is necessary to sustain life, such as the heart or colon. A non-vital organ is one that can be removed whereupon the individual is still able to survive. Examples of non-vital organs are ovary, breast, and prostate.

For example, Herceptin® is an FDA approved pharmaceutical that has as its active ingredient an antibody which is immunoreactive with the protein variously known as HER2, HER2/neu, and erb-b-2. It is marketed by Genentech and has been a commercially successful antitumor agent. Herceptin sales reached almost $400 million in 2002. Herceptin is a treatment for HER2 positive metastatic breast cancer. However, the expression of HER2 is not limited to such tumors. The same protein is expressed in a number of normal tissues. In particular, it is known that HER2/neu is present in normal kidney and heart, thus these tissues are present in all human recipients of Herceptin. The presence of HER2/neu in normal kidney is also confirmed by Latif, Z., et al., B.J.U. International (2002) 89:5-9. As shown in this article (which evaluated whether renal cell carcinoma should be a preferred indication for anti-HER2 antibodies such as Herceptin) both protein and mRNA are produced in benign renal tissues. Notably, HER2/neu protein was strongly overexpressed in benign renal tissue.

Despite the fact that HER2/neu is expressed in such vital tissues as heart and kidney, Herceptin is a very useful, FDA approved, and commercially successful drug. The effect of Herceptin on cardiac tissue, i.e., "cardiotoxicity," has merely been a side effect to treatment. When patients were treated with Herceptin alone, significant cardiotoxicity occurred in a very low percentage of patients.

Of particular note, although kidney tissue is indicated to exhibit normal expression, possibly even higher expression than cardiac tissue, kidney has no appreciable Herceptin side effect whatsoever. Moreover, of the diverse array of normal tissues in which HER2 is expressed, there is very little occurrence of any side effect. Only cardiac tissue has manifested any appreciable side effect at all. A tissue such as kidney, where HER2/neu expression is especially notable, has not been the basis for any side effect.

Furthermore, favorable therapeutic effects have been found for antitumor therapies that target epidermal growth factor receptor (EGFR). EGFR is also expressed in numerous normal tissues. There have been very limited side effects in normal tissues following use of anti-EGFR therapeutics.

Thus, expression of a target protein in normal tissue, even vital normal tissue, does not defeat the utility of a targeting agent for the protein as a therapeutic for certain tumors in which the protein is also overexpressed.

Accordingly, therapeutic approaches that inhibit the activity of a 158P3D2 protein are useful for patients suffering from a cancer that expresses 158P3D2. These therapeutic approaches generally fall into two classes. One class comprises various methods for inhibiting the binding or association of a 158P3D2 protein with its binding partner or with other proteins. Another class comprises a variety of methods for inhibiting the transcription of a 158P3D2 gene or translation of 158P3D2 mRNA.

X.A.) Anti-Cancer Vaccines

The invention provides cancer vaccines comprising a 158P3D2-related protein or 158P3D2-related nucleic acid. In view of the expression of 158P3D2, cancer vaccines prevent and/or treat 158P3D2-expressing cancers with minimal or no effects on non-target tissues. The use of a tumor antigen in a vaccine that generates humoral and/or cell-mediated immune responses as anti-cancer therapy is well known in the art and has been employed in prostate cancer using human PSMA and rodent PAP immunogens (Hodge et al., 1995, Int. J. Cancer 63:231-237; Fong et al., 1997, J. Immunol. 159:3113-3117).

Such methods can be readily practiced by employing a 158P3D2-related protein, or a 158P3D2-encoding nucleic acid molecule and recombinant vectors capable of expressing and presenting the 158P3D2 immunogen (which typically comprises a number of antibody or T cell epitopes). Skilled artisans understand that a wide variety of vaccine systems for delivery of immunoreactive epitopes are known in the art (see, e.g., Heryln et al., Ann Med 1999 February 31(1):66-78; Maruyama et al., Cancer Immunol Immunother 2000 June 49(3): 123-32) Briefly, such methods of generating an immune response (e.g. humoral and/or cell-mediated) in a mammal, comprise the steps of: exposing the mammal's immune system to an immunoreactive epitope (e.g. an epitope present in a 158P3D2 protein shown in FIG. 3 or analog or homolog thereof) so that the mammal generates an immune response that is specific for that epitope (e.g. generates antibodies that specifically recognize that epitope). In a preferred method, a 158P3D2 immunogen contains a biological motif, see e.g., Tables VIII-XXI and XXII-XLIX, or a peptide of a size range from 158P3D2 indicated in FIG. 5, FIG. 6, FIG. 7, FIG. 8, and FIG. 9.

The entire 158P3D2 protein, immunogenic regions or epitopes thereof can be combined and delivered by various means. Such vaccine compositions can include, for example, lipopeptides (e.g., Vitiello, A. et al., J. Clin. Invest. 95:341, 1995), peptide compositions encapsulated in poly(DL-lactide-co-glycolide) ("PLG") microspheres (see, e.g., Eldridge, et al., Molec. Immunol. 28:287-294, 1991: Alonso et al., Vaccine 12:299-306, 1994; Jones et al., Vaccine 13:675-681, 1995), peptide compositions contained in immune stimulating complexes (ISCOMS) (see, e.g., Takahashi et al., Nature 344:873-875, 1990; Hu et al., Clin Exp Immunol. 113:235-243, 1998), multiple antigen peptide systems (MAPs) (see e.g., Tam, J. P., Proc. Natl. Acad. Sci. U.S.A. 85:5409-5413, 1988; Tam, J.P., J. Immunol. Methods 196:17-32, 1996), peptides formulated as multivalent peptides; peptides for use in ballistic delivery systems, typically crystallized peptides, viral delivery vectors (Perkus, M. E. et al., In: Concepts in vaccine development, Kaufmann, S. H. E., ed., p. 379, 1996; Chakrabarti, S. et al., Nature 320:535, 1986; Hu, S. L. et al., Nature 320:537, 1986; Kieny, M.-P. et al., AIDS Bio/Technology 4:790, 1986; Top, F. H. et al., J. Infect. Dis. 124:148, 1971; Chanda, P. K. et al., Virology 175:535, 1990), particles of viral or synthetic origin (e.g., Kofler, N. et al., J. Immunol. Methods. 192:25, 1996; Eldridge, J. H. et al., Sem. Hematol. 30:16, 1993; Falo, L. D., Jr. et al., Nature Med. 7:649, 1995), adjuvants (Warren, H. S., Vogel, F. R., and Chedid, L. A. Annu. Rev. Immunol. 4:369, 1986; Gupta, R. K. et al., Vaccine 11:293, 1993), liposomes (Reddy, R. et al., J. Immunol. 148:1585, 1992; Rock, K. L., Immunol. Today 17:131, 1996), or, naked or particle absorbed cDNA (Ulmer, J. B. et al., Science 259:1745, 1993; Robinson, H. L., Hunt, L. A., and Webster, R. G., Vaccine 11:957, 1993; Shiver, J. W. et al., In: Concepts in vaccine development, Kaufmann, S. H. E., ed., p. 423, 1996; Cease, K. B., and Berzofsky, J. A., Annu. Rev. Immunol. 12:923, 1994 and Eldridge, J. H. et al., Sem. Hematol. 30:16, 1993). Toxin-targeted delivery technologies, also known as receptor mediated targeting, such as those of Avant Immunotherapeutics, Inc. (Needham, Mass.) may also be used.

In patients with 158P3D2-associated cancer, the vaccine compositions of the invention can also be used in conjunction with other treatments used for cancer, e.g., surgery, chemotherapy, drug therapies, radiation therapies, etc. including use in combination with immune adjuvants such as IL-2, IL-12, GM-CSF, and the like.

X.A.1. Cellular Vaccines

CTL epitopes can be determined using specific algorithms to identify peptides within 158P3D2 protein that bind corresponding HLA alleles (see e.g., Table IV; Epimer™ and Epimatrix™, Brown University (URL brown.edu/Research/TB-HIV_Lab/epimatrix/epimatrix.html); and, BIMAS, (URL bimas.dcrt.nih.gov/; SYFPEITHI at URL syfpeithi.bmi-heidelberg.com/). In a preferred embodiment, a 158P3D2 immunogen contains one or more amino acid sequences identified using techniques well known in the art, such as the sequences shown in Tables VIII-XXI and XXII-XLIX or a peptide of 8, 9, 10 or 11 amino acids specified by an HLA Class I motif/supermotif (e.g., Table IV (A), Table IV (D), or Table IV (E)) and/or a peptide of at least 9 amino acids that comprises an HLA Class II motif/supermotif (e.g., Table IV (B) or Table IV (C)). As is appreciated in the art, the HLA Class I binding groove is essentially closed ended so that peptides of only a particular size range can fit into the groove and be bound, generally HLA Class I epitopes are 8, 9, 10, or 11 amino acids long. In contrast, the HLA Class II binding groove is essentially open ended; therefore a peptide of about 9 or more amino acids can be bound by an HLA Class II molecule. Due to the binding groove differences between HLA Class I and II, HLA Class I motifs are length specific, i.e., position two of a Class I motif is the second amino acid in an amino to carboxyl direction of the peptide. The amino acid positions in a Class II motif are relative only to each other, not the overall peptide, i.e., additional amino acids can be attached to the amino and/or carboxyl termini of a motif-bearing sequence. HLA Class II epitopes are often 9, 10, 11, 12, 13, 14, 15, 16, 17, 18, 19, 20, 21, 22, 23, 24, or 25 amino acids long, or longer than 25 amino acids.

X.A.2. Antibody-Based Vaccines

A wide variety of methods for generating an immune response in a mammal are known in the art (for example as the first step in the generation of hybridomas). Methods of generating an immune response in a mammal comprise exposing the mammal's immune system to an immunogenic epitope on a protein (e.g. a 158P3D2 protein) so that an immune response is generated. A typical embodiment consists of a method for generating an immune response to 158P3D2 in a host, by contacting the host with a sufficient amount of at least one 158P3D2 B cell or cytotoxic T-cell epitope or analog thereof; and at least one periodic interval thereafter re-contacting the host with the 158P3D2 B cell or cytotoxic T-cell epitope or analog thereof. A specific embodiment consists of a method of generating an immune response against a 158P3D2-related protein or a man-made multiepitopic peptide comprising: administering 158P3D2 immunogen (e.g. a 158P3D2 protein or a peptide fragment thereof, a 158P3D2 fusion protein or analog etc.) in a vaccine preparation to a human or another mammal. Typically, such vaccine preparations further contain a suitable adjuvant (see, e.g., U.S. Pat. No. 6,146,635) or a universal helper epitope such as a PADRE™ peptide (Epimmune Inc., San Diego, Calif.; see, e.g., Alexander et al., J. Immunol. 2000 164(3); 164(3): 1625-1633; Alexander et al., Immunity 1994 1(9): 751-761 and Alexander et al., Immunol. Res. 1998 18(2): 79-92). An alternative method comprises generating an immune response in an individual against a 158P3D2 immunogen by: administering in vivo to muscle or skin of the individual's body a DNA molecule that comprises a DNA sequence that encodes a 158P3D2 immunogen, the DNA sequence operatively linked to regulatory sequences which control the expression of the DNA sequence; wherein the DNA molecule is taken up by cells, the DNA sequence is expressed in the cells and an immune response is generated against the immunogen (see, e.g., U.S. Pat. No. 5,962,428). Optionally a genetic vaccine facilitator such as anionic lipids; saponins; lectins; estrogenic compounds; hydroxylated lower alkyls; dimethyl sulfoxide; and urea is also administered. In addition, an antiidiotypic antibody can be administered that mimics 158P3D2, in order to generate a response to the target antigen.

X.A.3. Nucleic Acid Vaccines:

Vaccine compositions of the invention include nucleic acid-mediated modalities. DNA or RNA that encode protein(s) of the invention can be administered to a patient. Genetic immunization methods can be employed to generate prophylactic or therapeutic humoral and cellular immune responses directed against cancer cells expressing 158P3D2. Constructs comprising DNA encoding a 158P3D2-related protein/immunogen and appropriate regulatory sequences can be injected directly into muscle or skin of an individual, such that the cells of the muscle or skin take-up the construct and express the encoded 158P3D2 protein/immunogen. Alternatively, a vaccine comprises a 158P3D2-related protein. Expression of the 158P3D2-related protein immunogen results in the generation of prophylactic or therapeutic humoral and cellular immunity against cells that bear a 158P3D2 protein. Various prophylactic and therapeutic genetic immunization techniques known in the art can be used (for review, see information and references published at Internet address genweb.com). Nucleic acid-based delivery is described, for instance, in Wolff et. al., Science 247:1465 (1990) as well as U.S. Pat. Nos. 5,580,859; 5,589,466; 5,804, 566; 5,739,118; 5,736,524; 5,679,647; WO 98/04720. Examples of DNA-based delivery technologies include "naked DNA", facilitated (bupivicaine, polymers, peptide-mediated) delivery, cationic lipid complexes, and particle-mediated ("gene gun") or pressure-mediated delivery (see, e.g., U.S. Pat. No. 5,922,687).

For therapeutic or prophylactic immunization purposes, proteins of the invention can be expressed via viral or bacterial vectors. Various viral gene delivery systems that can be used in the practice of the invention include, but are not limited to, vaccinia, fowlpox, canarypox, adenovirus, influenza, poliovirus, adeno-associated virus, lentivirus, and sindbis virus (see, e.g., Restifo, 1996, Curr. Opin. Immunol. 8:658-663; Tsang et al. J. Natl. Cancer Inst. 87:982-990 (1995)). Non-viral delivery systems can also be employed by introducing naked DNA encoding a 158P3D2-related protein into the patient (e.g., intramuscularly or intradermally) to induce an anti-tumor response.

Vaccinia virus is used, for example, as a vector to express nucleotide sequences that encode the peptides of the invention. Upon introduction into a host, the recombinant vaccinia virus expresses the protein immunogenic peptide, and thereby elicits a host immune response. Vaccinia vectors and methods useful in immunization protocols are described in, e.g., U.S. Pat. No. 4,722,848. Another vector is BCG (Bacille Calmette Guerin). BCG vectors are described in Stover et al., Nature 351:456-460 (1991). A wide variety of other vectors useful for therapeutic administration or immunization of the peptides of the invention, e.g. adeno and adeno-associated virus vectors, retroviral vectors, *Salmonella typhi* vectors, detoxified anthrax toxin vectors, and the like, will be apparent to those skilled in the art from the description herein.

Thus, gene delivery systems are used to deliver a 158P3D2-related nucleic acid molecule. In one embodiment, the full-length human 158P3D2 cDNA is employed. In another embodiment, 158P3D2 nucleic acid molecules encoding specific cytotoxic T lymphocyte (CTL) and/or antibody epitopes are employed.

X.A.4. Ex Vivo Vaccines

Various ex vivo strategies can also be employed to generate an immune response. One approach involves the use of antigen presenting cells (APCs) such as dendritic cells (DC) to present 158P3D2 antigen to a patient's immune system. Dendritic cells express MHC class I and II molecules, B7 costimulator, and IL-12, and are thus highly specialized antigen presenting cells. In prostate cancer, autologous dendritic cells pulsed with peptides of the prostate-specific membrane antigen (PSMA) are being used in a Phase I clinical trial to stimulate prostate cancer patients' immune systems (Tjoa et al., 1996, Prostate 28:65-69; Murphy et al., 1996, Prostate 29:371-380). Thus, dendritic cells can be used to present 158P3D2 peptides to T cells in the context of MHC class I or II molecules. In one embodiment, autologous dendritic cells are pulsed with 158P3D2 peptides capable of binding to MHC class I and/or class II molecules. In another embodiment, dendritic cells are pulsed with the complete 158P3D2 protein. Yet another embodiment involves engineering the overexpression of a 158P3D2 gene in dendritic cells using various implementing vectors known in the art, such as adenovirus (Arthur et al., 1997, Cancer Gene Ther. 4:17-25), retrovirus (Henderson et al., 1996, Cancer Res. 56:3763-3770), lentivirus, adeno-associated virus, DNA transfection (Ribas et al., 1997, Cancer Res. 57:2865-2869), or tumor-derived RNA transfection (Ashley et al., 1997, J. Exp. Med. 186: 1177-1182). Cells that express 158P3D2 can also be engineered to express immune modulators, such as GM-CSF, and used as immunizing agents.

X.B.) 158P3D2 as a Target for Antibody-Based Therapy

158P3D2 is an attractive target for antibody-based therapeutic strategies. A number of antibody strategies are known in the art for targeting both extracellular and intracellular molecules (see, e.g., complement and ADCC mediated killing as well as the use of intrabodies). Because 158P3D2 is expressed by cancer cells of various lineages relative to corresponding normal cells, systemic administration of 158P3D2-immunoreactive compositions are prepared that exhibit excellent sensitivity without toxic, non-specific and/or non-target effects caused by binding of the immunoreactive composition to non-target organs and tissues. Antibodies specifically reactive with domains of 158P3D2 are useful to treat 158P3D2-expressing cancers systemically, either as conjugates with a toxin or therapeutic agent, or as naked antibodies capable of inhibiting cell proliferation or function.

158P3D2 antibodies can be introduced into a patient such that the antibody binds to 158P3D2 and modulates a function, such as an interaction with a binding partner, and consequently mediates destruction of the tumor cells and/or inhibits the growth of the tumor cells. Mechanisms by which such antibodies exert a therapeutic effect can include complement-mediated cytolysis, antibody-dependent cellular cytotoxicity, modulation of the physiological function of 158P3D2, inhibition of ligand binding or signal transduction pathways, modulation of tumor cell differentiation, alteration of tumor angiogenesis factor profiles, and/or apoptosis.

Those skilled in the art understand that antibodies can be used to specifically target and bind immunogenic molecules such as an immunogenic region of a 158P3D2 sequence shown in FIG. 2 or FIG. 3. In addition, skilled artisans understand that it is routine to conjugate antibodies to cytotoxic agents (see, e.g., Slevers et al. Blood 93:11 3678-3684 (Jun. 1, 1999)). When cytotoxic and/or therapeutic agents are delivered directly to cells, such as by conjugating them to antibodies specific for a molecule expressed by that cell (e.g. 158P3D2), the cytotoxic agent will exert its known biological effect (i.e. cytotoxicity) on those cells.

A wide variety of compositions and methods for using antibody-cytotoxic agent conjugates to kill cells are known in the art. In the context of cancers, typical methods entail administering to an animal having a tumor a biologically effective amount of a conjugate comprising a selected cytotoxic and/or therapeutic agent linked to a targeting agent (e.g. an anti-158P3D2 antibody) that binds to a marker (e.g. 158P3D2) expressed, accessible to binding or localized on the cell surfaces. A typical embodiment is a method of delivering a cytotoxic and/or therapeutic agent to a cell expressing 158P3D2, comprising conjugating the cytotoxic agent to an antibody that immunospecifically binds to a 158P3D2 epitope, and, exposing the cell to the antibody-agent conjugate. Another illustrative embodiment is a method of treating an individual suspected of suffering from metastasized cancer, comprising a step of administering parenterally to said individual a pharmaceutical composition comprising a therapeutically effective amount of an antibody conjugated to a cytotoxic and/or therapeutic agent.

Cancer immunotherapy using anti-158P3D2 antibodies can be done in accordance with various approaches that have been successfully employed in the treatment of other types of cancer, including but not limited to colon cancer (Arlen et al., 1998, Crit. Rev. Immunol. 18:133-138), multiple myeloma (Ozaki et al., 1997, Blood 90:3179-3186, Tsunenari et al., 1997, Blood 90:2437-2444), gastric cancer (Kasprzyk et al., 1992, Cancer Res. 52:2771-2776), B-cell lymphoma (Funakoshi et al., 1996, J. Immunother. Emphasis Tumor Immunol. 19:93-101), leukemia (Zhong et al., 1996, Leuk. Res. 20:581-589), colorectal cancer (Moun et al., 1994, Cancer Res. 54:6160-6166; Velders et al., 1995, Cancer Res. 55:4398-4403), and breast cancer (Shepard et al., 1991, J. Clin. Immunol. 11:117-127). Some therapeutic approaches involve conjugation of naked antibody to a toxin or radioisotope, such as the conjugation of Y91 or I131 to anti-CD20 antibodies (e.g., Zevalin™, IDEC Pharmaceuticals Corp. or Bexxar™, Coulter Pharmaceuticals), while others involve co-administration of antibodies and other therapeutic agents, such as Herceptin™ (trastuzumab) with paclitaxel (Genentech, Inc.). The antibodies can be conjugated to a therapeutic agent. To treat prostate cancer, for example, 158P3D2 antibodies can be administered in conjunction with radiation, chemotherapy or hormone ablation. Also, antibodies can be conjugated to a toxin such as calicheamicin (e.g., Mylotarg™, Wyeth-Ayerst, Madison, N.J., a recombinant humanized IgG4 kappa antibody conjugated to antitumor antibiotic calicheamicin) or a maytansinoid (e.g., taxane-based Tumor-Activated Prodrug, TAP, platform, ImmunoGen, Cambridge, Mass., also see e.g., U.S. Pat. No. 5,416,064).

Although 158P3D2 antibody therapy is useful for all stages of cancer, antibody therapy can be particularly appropriate in advanced or metastatic cancers. Treatment with the antibody therapy of the invention is indicated for patients who have received one or more rounds of chemotherapy. Alternatively, antibody therapy of the invention is combined with a chemotherapeutic or radiation regimen for patients who have not received chemotherapeutic treatment. Additionally, antibody therapy can enable the use of reduced dosages of concomitant chemotherapy, particularly for patients who do not tolerate the toxicity of the chemotherapeutic agent very well. Fan et al. (Cancer Res. 53:4637-4642, 1993), Prewett et al. (International J. of Onco. 9:217-224, 1996), and Hancock et al. (Cancer Res. 51:4575-4580, 1991) describe the use of various antibodies together with chemotherapeutic agents.

Although 158P3D2 antibody therapy is useful for all stages of cancer, antibody therapy can be particularly appropriate in advanced or metastatic cancers. Treatment with the antibody therapy of the invention is indicated for patients who have received one or more rounds of chemotherapy. Alternatively, antibody therapy of the invention is combined with a chemotherapeutic or radiation regimen for patients who have not received chemotherapeutic treatment. Additionally, antibody therapy can enable the use of reduced dosages of concomitant chemotherapy, particularly for patients who do not tolerate the toxicity of the chemotherapeutic agent very well.

Cancer patients can be evaluated for the presence and level of 158P3D2 expression, preferably using immunohistochemical assessments of tumor tissue, quantitative 158P3D2 imaging, or other techniques that reliably indicate the presence and degree of 158P3D2 expression. Immunohistochemical analysis of tumor biopsies or surgical specimens is preferred for this purpose. Methods for immunohistochemical analysis of tumor tissues are well known in the art.

Anti-158P3D2 monoclonal antibodies that treat prostate and other cancers include those that initiate a potent immune response against the tumor or those that are directly cytotoxic. In this regard, anti-158P3D2 monoclonal antibodies (mAbs) can elicit tumor cell lysis by either complement-mediated or antibody-dependent cell cytotoxicity (ADCC) mechanisms, both of which require an intact Fc portion of the immunoglobulin molecule for interaction with effector cell Fc receptor sites on complement proteins. In addition, anti-158P3D2 mAbs that exert a direct biological effect on tumor growth are useful to treat cancers that express 158P3D2. Mechanisms by which directly cytotoxic mAbs act include: inhibition of cell growth, modulation of cellular differentiation, modulation of tumor angiogenesis factor profiles, and the induction of apoptosis. The mechanism(s) by which a particular anti-158P3D2 mAb exerts an anti-tumor effect is evaluated using any number of in vitro assays that evaluate cell death such as ADCC, ADMMC, complement-mediated cell lysis, and so forth, as is generally known in the art.

In some patients, the use of murine or other non-human monoclonal antibodies, or human/mouse chimeric mAbs can induce moderate to strong immune responses against the non-human antibody. This can result in clearance of the antibody from circulation and reduced efficacy. In the most severe cases, such an immune response can lead to the extensive formation of immune complexes which, potentially, can cause renal failure. Accordingly, preferred monoclonal antibodies used in the therapeutic methods of the invention are those that are either fully human or humanized and that bind specifically to the target 158P3D2 antigen with high affinity but exhibit low or no antigenicity in the patient.

Therapeutic methods of the invention contemplate the administration of single anti-158P3D2 mAbs as well as combinations, or cocktails, of different mAbs. Such mAb cocktails can have certain advantages inasmuch as they contain mAbs that target different epitopes, exploit different effector mechanisms or combine directly cytotoxic mAbs with mAbs that rely on immune effector functionality. Such mAbs in combination can exhibit synergistic therapeutic effects. In addition, anti-158P3D2 mAbs can be administered concomitantly with other therapeutic modalities, including but not limited to various chemotherapeutic agents, androgen-blockers, immune modulators (e.g., IL-2, GM-CSF), surgery or radiation. The anti-158P3D2 mAbs are administered in their "naked" or unconjugated form, or can have a therapeutic agent(s) conjugated to them.

Anti-158P3D2 antibody formulations are administered via any route capable of delivering the antibodies to a tumor cell. Routes of administration include, but are not limited to, intravenous, intraperitoneal, intramuscular, intratumor, intradermal, and the like. Treatment generally involves repeated administration of the anti-158P3D2 antibody preparation, via an acceptable route of administration such as intravenous injection (IV), typically at a dose in the range of about 0.1, 0.2, 0.3, 0.4, 0.5, 0.6, 0.7, 0.8, 0.9, 1, 2, 3, 4, 5, 6, 7, 8, 9, 10, 15, 20, or 25 mg/kg body weight. In general, doses in the range of 10-1000 mg mAb per week are effective and well tolerated.

Based on clinical experience with the Herceptin™ mAb in the treatment of metastatic breast cancer, an initial loading dose of approximately 4 mg/kg patient body weight IV, followed by weekly doses of about 2 mg/kg IV of the anti-158P3D2 mAb preparation represents an acceptable dosing regimen. Preferably, the initial loading dose is administered as a 90-minute or longer infusion. The periodic maintenance dose is administered as a 30 minute or longer infusion, provided the initial dose was well tolerated. As appreciated by those of skill in the art, various factors can influence the ideal dose regimen in a particular case. Such factors include, for example, the binding affinity and half life of the Ab or mAbs used, the degree of 158P3D2 expression in the patient, the extent of circulating shed 158P3D2 antigen, the desired steady-state antibody concentration level, frequency of treatment, and the influence of chemotherapeutic or other agents used in combination with the treatment method of the invention, as well as the health status of a particular patient.

Optionally, patients should be evaluated for the levels of 158P3D2 in a given sample (e.g. the levels of circulating 158P3D2 antigen and/or 158P3D2 expressing cells) in order to assist in the determination of the most effective dosing regimen, etc. Such evaluations are also used for monitoring purposes throughout therapy, and are useful to gauge therapeutic success in combination with the evaluation of other parameters (for example, urine cytology and/or ImmunoCyt levels in bladder cancer therapy, or by analogy, serum PSA levels in prostate cancer therapy).

Anti-idiotypic anti-158P3D2 antibodies can also be used in anti-cancer therapy as a vaccine for inducing an immune response to cells expressing a 158P3D2-related protein. In particular, the generation of anti-idiotypic antibodies is well known in the art; this methodology can readily be adapted to generate anti-idiotypic anti-158P3D2 antibodies that mimic an epitope on a 158P3D2-related protein (see, for example, Wagner et al., 1997, Hybridoma 16: 33-40; Foon et al., 1995, J. Clin. Invest. 96:334-342; Herlyn et al., 1996, Cancer Immunol. Immunother. 43:65-76). Such an anti-idiotypic antibody can be used in cancer vaccine strategies.

X.C.) 158P3D2 as a Target for Cellular Immune Responses

Vaccines and methods of preparing vaccines that contain an immunogenically effective amount of one or more HLA-binding peptides as described herein are further embodiments of the invention. Furthermore, vaccines in accordance with the invention encompass compositions of one or more of the claimed peptides. A peptide can be present in a vaccine individually. Alternatively, the peptide can exist as a homopolymer comprising multiple copies of the same peptide, or as a heteropolymer of various peptides. Polymers have the advantage of increased immunological reaction and, where different peptide epitopes are used to make up the polymer, the additional ability to induce antibodies and/or CTLs that react with different antigenic determinants of the pathogenic organism or tumor-related peptide targeted for an immune response. The composition can be a naturally occurring region of an antigen or can be prepared, e.g., recombinantly or by chemical synthesis.

Carriers that can be used with vaccines of the invention are well known in the art, and include, e.g., thyroglobulin, albumins such as human serum albumin, tetanus toxoid, polyamino acids such as poly 1-lysine, poly 1-glutamic acid, influenza, hepatitis B virus core protein, and the like. The vaccines can contain a physiologically tolerable (i.e., acceptable) diluent such as water, or saline, preferably phosphate buffered saline. The vaccines also typically include an adjuvant. Adjuvants such as incomplete Freund's adjuvant, aluminum phosphate, aluminum hydroxide, or alum are examples of materials well known in the art. Additionally, as disclosed herein, CTL responses can be primed by conjugating peptides of the invention to lipids, such as tripalmitoyl-S-glycerylcysteinlyseryl-serine (P3CSS). Moreover, an adjuvant such as a synthetic cytosine-phosphorothiolated-guanine-containing (CpG) oligonucleotides has been found to increase CTL responses 10- to 100-fold. (see, e.g. Davila and Celis, J. Immunol. 165:539-547 (2000)).

Upon immunization with a peptide composition in accordance with the invention, via injection, aerosol, oral, transdermal, transmucosal, intrapleural, intrathecal, or other suitable routes, the immune system of the host responds to the vaccine by producing large amounts of CTLs and/or HTLs specific for the desired antigen. Consequently, the host becomes at least partially immune to later development of cells that express or overexpress 158P3D2 antigen, or derives at least some therapeutic benefit when the antigen was tumor-associated.

In some embodiments, it may be desirable to combine the class I peptide components with components that induce or facilitate neutralizing antibody and or helper T cell responses directed to the target antigen. A preferred embodiment of such a composition comprises class I and class II epitopes in accordance with the invention. An alternative embodiment of such a composition comprises a class I and/or class II epitope in accordance with the invention, along with a cross reactive HTL epitope such as PADRE™ (Epimmune, San Diego, Calif.) molecule (described e.g., in U.S. Pat. No. 5,736,142).

A vaccine of the invention can also include antigen-presenting cells (APC), such as dendritic cells (DC), as a vehicle to present peptides of the invention. Vaccine compositions can be created in vitro, following dendritic cell mobilization and harvesting, whereby loading of dendritic cells occurs in vitro. For example, dendritic cells are transfected, e.g., with a minigene in accordance with the invention, or are pulsed with peptides. The dendritic cell can then be administered to a patient to elicit immune responses in vivo. Vaccine compositions, either DNA- or peptide-based, can also be administered in vivo in combination with dendritic cell mobilization whereby loading of dendritic cells occurs in vivo.

Preferably, the following principles are utilized when selecting an array of epitopes for inclusion in a polyepitopic composition for use in a vaccine, or for selecting discrete epitopes to be included in a vaccine and/or to be encoded by nucleic acids such as a minigene. It is preferred that each of the following principles be balanced in order to make the selection. The multiple epitopes to be incorporated in a given vaccine composition may be, but need not be, contiguous in sequence in the native antigen from which the epitopes are derived.

1.) Epitopes are selected which, upon administration, mimic immune responses that have been observed to be correlated with tumor clearance. For HLA Class I this includes 3-4 epitopes that come from at least one tumor associated antigen (TAA). For HLA Class II a similar rationale is employed; again 3-4 epitopes are selected from at least one TAA (see, e.g., Rosenberg et al., Science 278:1447-1450). Epitopes from one TAA may be used in combination with epitopes from one or more additional TAAs to produce a vaccine that targets tumors with varying expression patterns of frequently-expressed TAAs.

2.) Epitopes are selected that have the requisite binding affinity established to be correlated with immunogenicity: for HLA Class I an IC50 of 500 nM or less, often 200 nM or less; and for Class II an IC50 of 1000 nM or less.

3.) Sufficient supermotif bearing-peptides, or a sufficient array of allele-specific motif-bearing peptides, are selected to give broad population coverage. For example, it is preferable to have at least 80% population coverage. A Monte Carlo analysis, a statistical evaluation known in the art, can be employed to assess the breadth, or redundancy of, population coverage.

4.) When selecting epitopes from cancer-related antigens it is often useful to select analogs because the patient may have developed tolerance to the native epitope.

5.) Of particular relevance are epitopes referred to as "nested epitopes." Nested epitopes occur where at least two epitopes overlap in a given peptide sequence. A nested peptide sequence can comprise B cell, HLA class I and/or HLA class II epitopes. When providing nested epitopes, a general objective is to provide the greatest number of epitopes per sequence. Thus, an aspect is to avoid providing a peptide that is any longer than the amino terminus of the amino terminal epitope and the carboxyl terminus of the carboxyl terminal epitope in the peptide. When providing a multi-epitopic sequence, such as a sequence comprising nested epitopes, it is generally important to screen the sequence in order to insure that it does not have pathological or other deleterious biological properties.

6.) If a polyepitopic protein is created, or when creating a minigene, an objective is to generate the smallest peptide that encompasses the epitopes of interest. This principle is similar, if not the same as that employed when selecting a peptide comprising nested epitopes. However, with an artificial polyepitopic peptide, the size minimization objective is balanced against the need to integrate any spacer sequences between epitopes in the polyepitopic protein. Spacer amino acid residues can, for example, be introduced to avoid junctional epitopes (an epitope recognized by the immune system, not present in the target antigen, and only created by the man-made juxtaposition of epitopes), or to facilitate cleavage between epitopes and thereby enhance epitope presentation. Junctional epitopes are generally to be avoided because the recipient may generate an immune response to that non-native epitope. Of particular concern is a junctional epitope that is a "dominant epitope." A dominant epitope may lead to such a zealous response that immune responses to other epitopes are diminished or suppressed.

7.) Where the sequences of multiple variants of the same target protein are present, potential peptide epitopes can also be selected on the basis of their conservancy. For example, a criterion for conservancy may define that the entire sequence of an HLA class I binding peptide or the entire 9-mer core of a class II binding peptide be conserved in a designated percentage of the sequences evaluated for a specific protein antigen.

X.C.1. Minigene Vaccines

A number of different approaches are available which allow simultaneous delivery of multiple epitopes. Nucleic acids encoding the peptides of the invention are a particularly useful embodiment of the invention. Epitopes for inclusion in a minigene are preferably selected according to the guidelines set forth in the previous section. A preferred means of administering nucleic acids encoding the peptides of the invention uses minigene constructs encoding a peptide comprising one or multiple epitopes of the invention.

The use of multi-epitope minigenes is described below and in, Ishioka et al., J. Immunol. 162:3915-3925, 1999; An, L. and Whitton, J. L., J. Virol. 71:2292, 1997; Thomson, S. A. et al., J. Immunol. 157:822, 1996; Whitton, J. L. et al., J. Virol. 67:348, 1993; Hanke, R. et al., Vaccine 16:426, 1998. For example, a multi-epitope DNA plasmid encoding supermotif- and/or motif-bearing epitopes derived 158P3D2, the PADRE® universal helper T cell epitope or multiple HTL epitopes from 158P3D2 (see e.g., Tables VIII-XXI and XXII to XLIX), and an endoplasmic reticulum-translocating signal sequence can be engineered. A vaccine may also comprise epitopes that are derived from other TAAs.

The immunogenicity of a multi-epitopic minigene can be confirmed in transgenic mice to evaluate the magnitude of CTL induction responses against the epitopes tested. Further, the immunogenicity of DNA-encoded epitopes in vivo can be correlated with the in vitro responses of specific CTL lines against target cells transfected with the DNA plasmid. Thus, these experiments can show that the minigene serves to both: 1.) generate a CTL response and 2.) that the induced CTLs recognized cells expressing the encoded epitopes.

For example, to create a DNA sequence encoding the selected epitopes (minigene) for expression in human cells, the amino acid sequences of the epitopes may be reverse translated. A human codon usage table can be used to guide the codon choice for each amino acid. These epitope-encoding DNA sequences may be directly adjoined, so that when translated, a continuous polypeptide sequence is created. To optimize expression and/or immunogenicity, additional elements can be incorporated into the minigene design. Examples of amino acid sequences that can be reverse translated and included in the minigene sequence include: HLA class I epitopes, HLA class II epitopes, antibody epitopes, a ubiquitination signal sequence, and/or an endoplasmic reticulum targeting signal. In addition, HLA presentation of CTL and HTL epitopes may be improved by including synthetic (e.g. poly-alanine) or naturally-occurring flanking sequences adjacent to the CTL or HTL epitopes; these larger peptides comprising the epitope(s) are within the scope of the invention.

The minigene sequence may be converted to DNA by assembling oligonucleotides that encode the plus and minus strands of the minigene. Overlapping oligonucleotides (30- 100 bases long) may be synthesized, phosphorylated, purified and annealed under appropriate conditions using well known techniques. The ends of the oligonucleotides can be joined, for example, using T4 DNA ligase. This synthetic minigene, encoding the epitope polypeptide, can then be cloned into a desired expression vector.

Standard regulatory sequences well known to those of skill in the art are preferably included in the vector to ensure expression in the target cells. Several vector elements are desirable: a promoter with a down-stream cloning site for minigene insertion; a polyadenylation signal for efficient transcription termination; an E. coli origin of replication; and an E. coli selectable marker (e.g. ampicillin or kanamycin resistance). Numerous promoters can be used for this purpose, e.g., the human cytomegalovirus (hCMV) promoter. See, e.g., U.S. Pat. Nos. 5,580,859 and 5,589,466 for other suitable promoter sequences.

Additional vector modifications may be desired to optimize minigene expression and immunogenicity. In some cases, introns are required for efficient gene expression, and one or more synthetic or naturally-occurring introns could be incorporated into the transcribed region of the minigene. The inclusion of mRNA stabilization sequences and sequences for replication in mammalian cells may also be considered for increasing minigene expression.

Once an expression vector is selected, the minigene is cloned into the polylinker region downstream of the promoter. This plasmid is transformed into an appropriate E. coli strain, and DNA is prepared using standard techniques. The orientation and DNA sequence of the minigene, as well as all other elements included in the vector, are confirmed using restriction mapping and DNA sequence analysis. Bacterial cells harboring the correct plasmid can be stored as a master cell bank and a working cell bank.

In addition, immunostimulatory sequences (ISSs or CpGs) appear to play a role in the immunogenicity of DNA vaccines. These sequences may be included in the vector, outside the minigene coding sequence, if desired to enhance immunogenicity.

In some embodiments, a bi-cistronic expression vector which allows production of both the minigene-encoded epitopes and a second protein (included to enhance or decrease immunogenicity) can be used. Examples of proteins or polypeptides that could beneficially enhance the immune response if co-expressed include cytokines (e.g., IL-2, IL-12, GM-CSF), cytokine-inducing molecules (e.g., LeIF), costimulatory molecules, or for HTL responses, pan-DR binding proteins (PADRE™, Epimmune, San Diego, Calif.). Helper (HTL) epitopes can be joined to intracellular targeting signals and expressed separately from expressed CTL epitopes; this allows direction of the HTL epitopes to a cell compartment different than that of the CTL epitopes. If required, this could facilitate more efficient entry of HTL epitopes into the HLA class II pathway, thereby improving HTL induction. In contrast to HTL or CTL induction, specifically decreasing the immune response by co-expression of immunosuppressive molecules (e.g. TGF-β) may be beneficial in certain diseases.

Therapeutic quantities of plasmid DNA can be produced for example, by fermentation in E. coli, followed by purification. Aliquots from the working cell bank are used to inoculate growth medium, and grown to saturation in shaker flasks or a bioreactor according to well-known techniques. Plasmid DNA can be purified using standard bioseparation technologies such as solid phase anion-exchange resins supplied by QIAGEN, Inc. (Valencia, Calif.). If required, supercoiled DNA can be isolated from the open circular and linear forms using gel electrophoresis or other methods.

Purified plasmid DNA can be prepared for injection using a variety of formulations. The simplest of these is reconstitution of lyophilized DNA in sterile phosphate-buffer saline (PBS). This approach, known as "naked DNA," is currently being used for intramuscular (IM) administration in clinical trials. To maximize the immunotherapeutic effects of minigene DNA vaccines, an alternative method for formulating purified plasmid DNA may be desirable. A variety of methods have been described, and new techniques may become available. Cationic lipids, glycolipids, and fusogenic liposomes can also be used in the formulation (see, e.g., as described by WO 93/24640; Mannino & Gould-Fogerite, BioTechniques 6(7): 682 (1988); U.S. Pat. No. 5,279,833; WO 91/06309; and Felgner, et al., Proc. Nat'l Acad. Sci. USA 84:7413 (1987). In addition, peptides and compounds referred to collectively as protective, interactive, non-condensing compounds (PINC)

could also be complexed to purified plasmid DNA to influence variables such as stability, intramuscular dispersion, or trafficking to specific organs or cell types.

Target cell sensitization can be used as a functional assay for expression and HLA class I presentation of minigene-encoded CTL epitopes. For example, the plasmid DNA is introduced into a mammalian cell line that is suitable as a target for standard CTL chromium release assays. The transfection method used will be dependent on the final formulation. Electroporation can be used for "naked" DNA, whereas cationic lipids allow direct in vitro transfection. A plasmid expressing green fluorescent protein (GFP) can be co-transfected to allow enrichment of transfected cells using fluorescence activated cell sorting (FACS). These cells are then chromium-51 (51Cr) labeled and used as target cells for epitope-specific CTL lines; cytolysis, detected by 51Cr release, indicates both production of, and HLA presentation of, minigene-encoded CTL epitopes. Expression of HTL epitopes may be evaluated in an analogous manner using assays to assess HTL activity.

In vivo immunogenicity is a second approach for functional testing of minigene DNA formulations. Transgenic mice expressing appropriate human HLA proteins are immunized with the DNA product. The dose and route of administration are formulation dependent (e.g., IM for DNA in PBS, intraperitoneal (i.p.) for lipid-complexed DNA). Twenty-one days after immunization, splenocytes are harvested and restimulated for one week in the presence of peptides encoding each epitope being tested. Thereafter, for CTL effector cells, assays are conducted for cytolysis of peptide-loaded, 51Cr-labeled target cells using standard techniques. Lysis of target cells that were sensitized by HLA loaded with peptide epitopes, corresponding to minigene-encoded epitopes, demonstrates DNA vaccine function for in vivo induction of CTLs. Immunogenicity of HTL epitopes is confirmed in transgenic mice in an analogous manner.

Alternatively, the nucleic acids can be administered using ballistic delivery as described, for instance, in U.S. Pat. No. 5,204,253. Using this technique, particles comprised solely of DNA are administered. In a further alternative embodiment, DNA can be adhered to particles, such as gold particles.

Minigenes can also be delivered using other bacterial or viral delivery systems well known in the art, e.g., an expression construct encoding epitopes of the invention can be incorporated into a viral vector such as vaccinia.

X.C.2. Combinations of CTL Peptides with Helper Peptides

Vaccine compositions comprising CTL peptides of the invention can be modified, e.g., analoged, to provide desired attributes, such as improved serum half life, broadened population coverage or enhanced immunogenicity.

For instance, the ability of a peptide to induce CTL activity can be enhanced by linking the peptide to a sequence which contains at least one epitope that is capable of inducing a T helper cell response. Although a CTL peptide can be directly linked to a T helper peptide, often CTL epitope/HTL epitope conjugates are linked by a spacer molecule. The spacer is typically comprised of relatively small, neutral molecules, such as amino acids or amino acid mimetics, which are substantially uncharged under physiological conditions. The spacers are typically selected from, e.g., Ala, Gly, or other neutral spacers of nonpolar amino acids or neutral polar amino acids. It will be understood that the optionally present spacer need not be comprised of the same residues and thus may be a hetero- or homo-oligomer. When present, the spacer will usually be at least one or two residues, more usually three to six residues and sometimes 10 or more residues. The CTL peptide epitope can be linked to the T helper peptide epitope either directly or via a spacer either at the amino or carboxy terminus of the CTL peptide. The amino terminus of either the immunogenic peptide or the T helper peptide may be acylated.

In certain embodiments, the T helper peptide is one that is recognized by T helper cells present in a majority of a genetically diverse population. This can be accomplished by selecting peptides that bind to many, most, or all of the HLA class II molecules. Examples of such amino acid bind many HLA Class II molecules include sequences from antigens such as tetanus toxoid at positions 830-843 QYIKANSKFIGITE; (SEQ ID NO: 63), *Plasmodium falciparum* circumsporozoite (CS) protein at positions 378-398 DIEKKIAKMEKASS-VFNVVNS; (SEQ ID NO: 64), and *Streptococcus* 18 kD protein at positions 116-131 GAVDSILGGVATYGAA; (SEQ ID NO: 65). Other examples include peptides bearing a DR 1-4-7 supermotif, or either of the DR3 motifs.

Alternatively, it is possible to prepare synthetic peptides capable of stimulating T helper lymphocytes, in a loosely HLA-restricted fashion, using amino acid sequences not found in nature (see, e.g., PCT publication WO 95/07707). These synthetic compounds called Pan-DR-binding epitopes (e.g., PADRE™, Epimmune, Inc., San Diego, Calif.) are designed, most preferably, to bind most HLA-DR (human HLA class II) molecules. For instance, a pan-DR-binding epitope peptide having the formula: xKXVAAWTLKAAx (SEQ ID NO: 66), where "X" is either cyclohexylalanine, phenylalanine, or tyrosine, and a is either d-alanine or 1-alanine, has been found to bind to most HLA-DR alleles, and to stimulate the response of T helper lymphocytes from most individuals, regardless of their HLA type. An alternative of a pan-DR binding epitope comprises all "L" natural amino acids and can be provided in the form of nucleic acids that encode the epitope.

HTL peptide epitopes can also be modified to alter their biological properties. For example, they can be modified to include d-amino acids to increase their resistance to proteases and thus extend their serum half life, or they can be conjugated to other molecules such as lipids, proteins, carbohydrates, and the like to increase their biological activity. For example, a T helper peptide can be conjugated to one or more palmitic acid chains at either the amino or carboxyl termini.

X.C.3. Combinations of CTL Peptides with T Cell Priming Agents

In some embodiments it may be desirable to include in the pharmaceutical compositions of the invention at least one component which primes B lymphocytes or T lymphocytes. Lipids have been identified as agents capable of priming CTL in vivo. For example, palmitic acid residues can be attached to the ε- and α-amino groups of a lysine residue and then linked, e.g., via one or more linking residues such as Gly, Gly-Gly-, Ser, Ser-Ser, or the like, to an immunogenic peptide. The lipidated peptide can then be administered either directly in a micelle or particle, incorporated into a liposome, or emulsified in an adjuvant, e.g., incomplete Freund's adjuvant. In a preferred embodiment, a particularly effective immunogenic composition comprises palmitic acid attached to ε- and α-amino groups of Lys, which is attached via linkage, e.g., Ser-Ser, to the amino terminus of the immunogenic peptide.

As another example of lipid priming of CTL responses, *E. coli* lipoproteins, such as tripalmitoyl-S-glycerylcysteinly-seryl-serine (P3CSS) can be used to prime virus specific CTL when covalently attached to an appropriate peptide (see, e.g., Deres, et al., Nature 342:561, 1989). Peptides of the invention can be coupled to P3CSS, for example, and the lipopeptide administered to an individual to prime specifically an immune response to the target antigen. Moreover, because the induction of neutralizing antibodies can also be primed with P3CSS-conjugated epitopes, two such compositions can be combined to more effectively elicit both humoral and cell-mediated responses.

X.C.4. Vaccine Compositions Comprising DC Pulsed with CTL and/or HTL Peptides

An embodiment of a vaccine composition in accordance with the invention comprises ex vivo administration of a cocktail of epitope-bearing peptides to PBMC, or isolated DC therefrom, from the patient's blood. A pharmaceutical to facilitate harvesting of DC can be used, such as Progenipoietin™ (Pharmacia-Monsanto, St. Louis, Mo.) or GM-CSF/IL-4. After pulsing the DC with peptides and prior to reinfusion into patients, the DC are washed to remove unbound peptides. In this embodiment, a vaccine comprises peptide-pulsed DCs which present the pulsed peptide epitopes complexed with HLA molecules on their surfaces.

The DC can be pulsed ex vivo with a cocktail of peptides, some of which stimulate CTL responses to 158P3D2. Optionally, a helper T cell (HTL) peptide, such as a natural or artificial loosely restricted HLA Class II peptide, can be included to facilitate the CTL response. Thus, a vaccine in accordance with the invention is used to treat a cancer which expresses or overexpresses 158P3D2.

X.D.) Adoptive Immunotherapy

Antigenic 158P3D2-related peptides are used to elicit a CTL and/or HTL response ex vivo, as well. The resulting CTL or HTL cells, can be used to treat tumors in patients that do not respond to other conventional forms of therapy, or will not respond to a therapeutic vaccine peptide or nucleic acid in accordance with the invention. Ex vivo CTL or HTL responses to a particular antigen are induced by incubating in tissue culture the patient's, or genetically compatible, CTL or HTL precursor cells together with a source of antigen-presenting cells (APC), such as dendritic cells, and the appropriate immunogenic peptide. After an appropriate incubation time (typically about 7-28 days), in which the precursor cells are activated and expanded into effector cells, the cells are infused back into the patient, where they will destroy (CTL) or facilitate destruction (HTL) of their specific target cell (e.g., a tumor cell). Transfected dendritic cells may also be used as antigen presenting cells.

X.E.) Administration of Vaccines for Therapeutic or Prophylactic Purposes

Pharmaceutical and vaccine compositions of the invention are typically used to treat and/or prevent a cancer that expresses or overexpresses 158P3D2. In therapeutic applications, peptide and/or nucleic acid compositions are administered to a patient in an amount sufficient to elicit an effective B cell, CTL and/or HTL response to the antigen and to cure or at least partially arrest or slow symptoms and/or complications. An amount adequate to accomplish this is defined as "therapeutically effective dose." Amounts effective for this use will depend on, e.g., the particular composition administered, the manner of administration, the stage and severity of the disease being treated, the weight and general state of health of the patient, and the judgment of the prescribing physician.

For pharmaceutical compositions, the immunogenic peptides of the invention, or DNA encoding them, are generally administered to an individual already bearing a tumor that expresses 158P3D2. The peptides or DNA encoding them can be administered individually or as fusions of one or more peptide sequences. Patients can be treated with the immunogenic peptides separately or in conjunction with other treatments, such as surgery, as appropriate.

For therapeutic use, administration should generally begin at the first diagnosis of 158P3D2-associated cancer. This is followed by boosting doses until at least symptoms are substantially abated and for a period thereafter. The embodiment of the vaccine composition (i.e., including, but not limited to embodiments such as peptide cocktails, polyepitopic polypeptides, minigenes, or TAA-specific CTLs or pulsed dendritic cells) delivered to the patient may vary according to the stage of the disease or the patient's health status. For example, in a patient with a tumor that expresses 158P3D2, a vaccine comprising 158P3D2-specific CTL may be more efficacious in killing tumor cells in patient with advanced disease than alternative embodiments.

It is generally important to provide an amount of the peptide epitope delivered by a mode of administration sufficient to stimulate effectively a cytotoxic T cell response; compositions which stimulate helper T cell responses can also be given in accordance with this embodiment of the invention.

The dosage for an initial therapeutic immunization generally occurs in a unit dosage range where the lower value is about 1, 5, 50, 500, or 1,000 μg and the higher value is about 10,000; 20,000; 30,000; or 50,000 μg. Dosage values for a human typically range from about 500 μg to about 50,000 μg per 70 kilogram patient. Boosting dosages of between about 1.0 μg to about 50,000 μg of peptide pursuant to a boosting regimen over weeks to months may be administered depending upon the patient's response and condition as determined by measuring the specific activity of CTL and HTL obtained from the patient's blood. Administration should continue until at least clinical symptoms or laboratory tests indicate that the neoplasia, has been eliminated or reduced and for a period thereafter. The dosages, routes of administration, and dose schedules are adjusted in accordance with methodologies known in the art.

In certain embodiments, the peptides and compositions of the present invention are employed in serious disease states, that is, life-threatening or potentially life threatening situations. In such cases, as a result of the minimal amounts of extraneous substances and the relative nontoxic nature of the peptides in preferred compositions of the invention, it is possible and may be felt desirable by the treating physician to administer substantial excesses of these peptide compositions relative to these stated dosage amounts.

The vaccine compositions of the invention can also be used purely as prophylactic agents. Generally the dosage for an initial prophylactic immunization generally occurs in a unit dosage range where the lower value is about 1, 5, 50, 500, or 1000 μg and the higher value is about 10,000; 20,000; 30,000; or 50,000 μg. Dosage values for a human typically range from about 500 μg to about 50,000 μg per 70 kilogram patient. This is followed by boosting dosages of between about 1.0 μg to about 50,000 μg of peptide administered at defined intervals from about four weeks to six months after the initial administration of vaccine. The immunogenicity of the vaccine can be assessed by measuring the specific activity of CTL and HTL obtained from a sample of the patient's blood.

The pharmaceutical compositions for therapeutic treatment are intended for parenteral, topical, oral, nasal, intrathecal, or local (e.g. as a cream or topical ointment) administration. Preferably, the pharmaceutical compositions are administered parentally, e.g., intravenously, subcutaneously, intradermally, or intramuscularly. Thus, the invention provides compositions for parenteral administration which comprise a solution of the immunogenic peptides dissolved or suspended in an acceptable carrier, preferably an aqueous carrier.

A variety of aqueous carriers may be used, e.g., water, buffered water, 0.8% saline, 0.3% glycine, hyaluronic acid and the like. These compositions may be sterilized by conventional, well-known sterilization techniques, or may be sterile filtered. The resulting aqueous solutions may be packaged for use as is, or lyophilized, the lyophilized preparation being combined with a sterile solution prior to administration.

The compositions may contain pharmaceutically acceptable auxiliary substances as required to approximate physiological conditions, such as pH-adjusting and buffering agents, tonicity adjusting agents, wetting agents, preservatives, and the like, for example, sodium acetate, sodium lactate, sodium chloride, potassium chloride, calcium chloride, sorbitan monolaurate, triethanolamine oleate, etc.

The concentration of peptides of the invention in the pharmaceutical formulations can vary widely, i.e., from less than about 0.1%, usually at or at least about 2% to as much as 20% to 50% or more by weight, and will be selected primarily by fluid volumes, viscosities, etc., in accordance with the particular mode of administration selected.

A human unit dose form of a composition is typically included in a pharmaceutical composition that comprises a human unit dose of an acceptable carrier, in one embodiment an aqueous carrier, and is administered in a volume/quantity that is known by those of skill in the art to be used for administration of such compositions to humans (see, e.g., Remington's Pharmaceutical Sciences, 17th Edition, A. Gennaro, Editor, Mack Publishing Co., Easton, Pa., 1985). For example a peptide dose for initial immunization can be from about 1 to about 50,000 µg, generally 100-5,000 µg, for a 70 kg patient. For example, for nucleic acids an initial immunization may be performed using an expression vector in the form of naked nucleic acid administered IM (or SC or ID) in the amounts of 0.5-5 mg at multiple sites. The nucleic acid (0.1 to 1000 µg) can also be administered using a gene gun. Following an incubation period of 3-4 weeks, a booster dose is then administered. The booster can be recombinant fowlpox virus administered at a dose of 5-107 to 5×109 pfu.

For antibodies, a treatment generally involves repeated administration of the anti-158P3D2 antibody preparation, via an acceptable route of administration such as intravenous injection (IV), typically at a dose in the range of about 0.1 to about 10 mg/kg body weight. In general, doses in the range of 10-500 mg mAb per week are effective and well tolerated. Moreover, an initial loading dose of approximately 4 mg/kg patient body weight IV, followed by weekly doses of about 2 mg/kg IV of the anti-158P3D2 mAb preparation represents an acceptable dosing regimen. As appreciated by those of skill in the art, various factors can influence the ideal dose in a particular case. Such factors include, for example, half life of a composition, the binding affinity of an Ab, the immunogenicity of a substance, the degree of 158P3D2 expression in the patient, the extent of circulating shed 158P3D2 antigen, the desired steady-state concentration level, frequency of treatment, and the influence of chemotherapeutic or other agents used in combination with the treatment method of the invention, as well as the health status of a particular patient. Non-limiting preferred human unit doses are, for example, 500 µg-1 mg, 1 mg-50 mg, 50 mg-100 mg, 100 mg-200 mg, 200 mg-300 mg, 400 mg-500 mg, 500 mg-600 mg, 600 mg-700 mg, 700 mg-800 mg, 800 mg-900 mg, 900 mg-1 g, or 1 mg-700 mg. In certain embodiments, the dose is in a range of 2-5 mg/kg body weight, e.g., with follow on weekly doses of 1-3 mg/kg; 0.5 mg, 1, 2, 3, 4, 5, 6, 7, 8, 9, 10 mg/kg body weight followed, e.g., in two, three or four weeks by weekly doses; 0.5-10 mg/kg body weight, e.g., followed in two, three or four weeks by weekly doses; 225, 250, 275, 300, 325, 350, 375, 400 mg m2 of body area weekly; 1-600 mg m2 of body area weekly; 225-400 mg m2 of body area weekly; these does can be followed by weekly doses for 2, 3, 4, 5, 6, 7, 8, 9, 19, 11, 12 or more weeks.

In one embodiment, human unit dose forms of polynucleotides comprise a suitable dosage range or effective amount that provides any therapeutic effect. As appreciated by one of ordinary skill in the art a therapeutic effect depends on a number of factors, including the sequence of the polynucleotide, molecular weight of the polynucleotide and route of administration. Dosages are generally selected by the physician or other health care professional in accordance with a variety of parameters known in the art, such as severity of symptoms, history of the patient and the like. Generally, for a polynucleotide of about 20 bases, a dosage range may be selected from, for example, an independently selected lower limit such as about 0.1, 0.25, 0.5, 1, 2, 5, 10, 20, 30, 40, 50, 60, 70, 80, 90, 100, 200, 300, 400 or 500 mg/kg up to an independently selected upper limit, greater than the lower limit, of about 60, 80, 100, 200, 300, 400, 500, 750, 1000, 1500, 2000, 3000, 4000, 5000, 6000, 7000, 8000, 9000 or 10,000 mg/kg. For example, a dose may be about any of the following: 0.1 to 100 mg/kg, 0.1 to 50 mg/kg, 0.1 to 25 mg/kg, 0.1 to 10 mg/kg, 1 to 500 mg/kg, 100 to 400 mg/kg, 200 to 300 mg/kg, 1 to 100 mg/kg, 100 to 200 mg/kg, 300 to 400 mg/kg, 400 to 500 mg/kg, 500 to 1000 mg/kg, 500 to 5000 mg/kg, or 500 to 10,000 mg/kg. Generally, parenteral routes of administration may require higher doses of polynucleotide compared to more direct application to the nucleotide to diseased tissue, as do polynucleotides of increasing length.

In one embodiment, human unit dose forms of T-cells comprise a suitable dosage range or effective amount that provides any therapeutic effect. As appreciated by one of ordinary skill in the art, a therapeutic effect depends on a number of factors. Dosages are generally selected by the physician or other health care professional in accordance with a variety of parameters known in the art, such as severity of symptoms, history of the patient and the like. A dose may be about 104 cells to about 106 cells, about 106 cells to about 108 cells, about 108 to about 1011 cells, or about 108 to about 5×1010 cells. A dose may also about 106 cells/m2 to about 1010 cells/m2, or about 106 cells/m2 to about 108 cells/m2.

Proteins(s) of the invention, and/or nucleic acids encoding the protein(s), can also be administered via liposomes, which may also serve to: 1) target the proteins(s) to a particular tissue, such as lymphoid tissue; 2) to target selectively to diseases cells; or, 3) to increase the half-life of the peptide composition. Liposomes include emulsions, foams, micelles, insoluble monolayers, liquid crystals, phospholipid dispersions, lamellar layers and the like. In these preparations, the peptide to be delivered is incorporated as part of a liposome, alone or in conjunction with a molecule which binds to a receptor prevalent among lymphoid cells, such as monoclonal antibodies which bind to the CD45 antigen, or with other therapeutic or immunogenic compositions. Thus, liposomes either filled or decorated with a desired peptide of the invention can be directed to the site of lymphoid cells, where the liposomes then deliver the peptide compositions. Liposomes for use in accordance with the invention are formed from standard vesicle-forming lipids, which generally include neutral and negatively charged phospholipids and a sterol, such as cholesterol. The selection of lipids is generally guided by consideration of, e.g., liposome size, acid lability and stability of the liposomes in the blood stream. A variety of methods are available for preparing liposomes, as described in, e.g., Szoka, et al., Ann. Rev. Biophys. Bioeng. 9:467 (1980), and U.S. Pat. Nos. 4,235,871, 4,501,728, 4,837,028, and 5,019,369.

For targeting cells of the immune system, a ligand to be incorporated into the liposome can include, e.g., antibodies or fragments thereof specific for cell surface determinants of the desired immune system cells. A liposome suspension containing a peptide may be administered intravenously, locally, topically, etc. in a dose which varies according to, inter alia, the manner of administration, the peptide being delivered, and the stage of the disease being treated.

For solid compositions, conventional nontoxic solid carriers may be used which include, for example, pharmaceutical grades of mannitol, lactose, starch, magnesium stearate, sodium saccharin, talcum, cellulose, glucose, sucrose, magnesium carbonate, and the like. For oral administration, a pharmaceutically acceptable nontoxic composition is formed by incorporating any of the normally employed excipients, such as those carriers previously listed, and generally 10-95% of active ingredient, that is, one or more peptides of the invention, and more preferably at a concentration of 25%-75%.

For aerosol administration, immunogenic peptides are preferably supplied in finely divided form along with a surfactant and propellant. Typical percentages of peptides are about 0.01%-20% by weight, preferably about 1%-10%. The surfactant must, of course, be nontoxic, and preferably soluble in the propellant. Representative of such agents are the esters or partial esters of fatty acids containing from about 6 to 22 carbon atoms, such as caproic, octanoic, lauric, palmitic, stearic, linoleic, linolenic, olesteric and oleic acids with an aliphatic polyhydric alcohol or its cyclic anhydride. Mixed esters, such as mixed or natural glycerides may be employed. The surfactant may constitute about 0.1%-20% by weight of the composition, preferably about 0.25-5%. The balance of the composition is ordinarily propellant. A carrier can also be included, as desired, as with, e.g., lecithin for intranasal delivery.

XI.) DIAGNOSTIC AND PROGNOSTIC EMBODIMENTS OF 158P3D2

As disclosed herein, 158P3D2 polynucleotides, polypeptides, reactive cytotoxic T cells (CTL), reactive helper T cells (HTL) and anti-polypeptide antibodies are used in well known diagnostic, prognostic and therapeutic assays that examine conditions associated with dysregulated cell growth such as cancer, in particular the cancers listed in Table I (see, e.g., both its specific pattern of tissue expression as well as its overexpression in certain cancers as described for example in the Example entitled "Expression analysis of 158P3D2 in normal tissues, and patient specimens").

158P3D2 can be analogized to a prostate associated antigen PSA, the archetypal marker that has been used by medical practitioners for years to identify and monitor the presence of prostate cancer (see, e.g., Merrill et al., J. Urol. 163(2): 503-5120 (2000); Polascik et al., J. Urol. August; 162(2):293-306 (1999) and Fortier et al., J. Nat. Cancer Inst. 91(19): 1635-1640(1999)). A variety of other diagnostic markers are also used in similar contexts including p53 and K-ras (see, e.g., Tulchinsky et al., Int J Mol Med 1999 July 4(1):99-102 and Minimoto et al., Cancer Detect Prev 2000; 24(1):1-12). Therefore, this disclosure of 158P3D2 polynucleotides and polypeptides (as well as 158P3D2 polynucleotide probes and anti-158P3D2 antibodies used to identify the presence of these molecules) and their properties allows skilled artisans to utilize these molecules in methods that are analogous to those used, for example, in a variety of diagnostic assays directed to examining conditions associated with cancer.

Typical embodiments of diagnostic methods which utilize the 158P3D2 polynucleotides, polypeptides, reactive T cells and antibodies are analogous to those methods from well-established diagnostic assays, which employ, e.g., PSA polynucleotides, polypeptides, reactive T cells and antibodies. For example, just as PSA polynucleotides are used as probes (for example in Northern analysis, see, e.g., Sharief et al., Biochem. Mol. Biol. Int. 33(3):567-74(1994)) and primers (for example in PCR analysis, see, e.g., Okegawa et al., J. Urol. 163(4): 1189-1190 (2000)) to observe the presence and/or the level of PSA mRNAs in methods of monitoring PSA overexpression or the metastasis of prostate cancers, the 158P3D2 polynucleotides described herein can be utilized in the same way to detect 158P3D2 overexpression or the metastasis of prostate and other cancers expressing this gene. Alternatively, just as PSA polypeptides are used to generate antibodies specific for PSA which can then be used to observe the presence and/or the level of PSA proteins in methods to monitor PSA protein overexpression (see, e.g., Stephan et al., Urology 55(4):560-3 (2000)) or the metastasis of prostate cells (see, e.g., Alanen et al., Pathol. Res. Pract. 192(3):233-7 (1996)), the 158P3D2 polypeptides described herein can be utilized to generate antibodies for use in detecting 158P3D2 overexpression or the metastasis of prostate cells and cells of other cancers expressing this gene.

Specifically, because metastases involves the movement of cancer cells from an organ of origin (such as the lung or prostate gland etc.) to a different area of the body (such as a lymph node), assays which examine a biological sample for the presence of cells expressing 158P3D2 polynucleotides and/or polypeptides can be used to provide evidence of metastasis. For example, when a biological sample from tissue that does not normally contain 158P3D2-expressing cells (lymph node) is found to contain 158P3D2-expressing cells such as the 158P3D2 expression seen in LAPC4 and LAPC9, xenografts isolated from lymph node and bone metastasis, respectively, this finding is indicative of metastasis.

Alternatively 158P3D2 polynucleotides and/or polypeptides can be used to provide evidence of cancer, for example, when cells in a biological sample that do not normally express 158P3D2 or express 158P3D2 at a different level are found to express 158P3D2 or have an increased expression of 158P3D2 (see, e.g., the 158P3D2 expression in the cancers listed in Table I and in patient samples etc. shown in the accompanying Figures). In such assays, artisans may further wish to generate supplementary evidence of metastasis by testing the biological sample for the presence of a second tissue restricted marker (in addition to 158P3D2) such as PSA, PSCA etc. (see, e.g., Alanen et al., Pathol. Res. Pract. 192(3): 233-237 (1996)).

The use of immunohistochemistry to identify the presence of a 158P3D2 polypeptide within a tissue section can indicate an altered state of certain cells within that tissue. It is well understood in the art that the ability of an antibody to localize to a polypeptide that is expressed in cancer cells is a way of diagnosing presence of disease, disease stage, progression and/or tumor aggressiveness. Such an antibody can also detect an altered distribution of the polypeptide within the cancer cells, as compared to corresponding non-malignant tissue.

The 158P3D2 polypeptide and immunogenic compositions are also useful in view of the phenomena of altered subcellular protein localization in disease states. Alteration of cells from normal to diseased state causes changes in cellular morphology and is often associated with changes in subcellular protein localization/distribution. For example, cell membrane proteins that are expressed in a polarized manner in normal cells can be altered in disease, resulting in distribution of the protein in a non-polar manner over the whole cell surface.

The phenomenon of altered subcellular protein localization in a disease state has been demonstrated with MUC1 and Her2 protein expression by use of immunohistochemical means. Normal epithelial cells have a typical apical distribution of MUC1, in addition to some supranuclear localization of the glycoprotein, whereas malignant lesions often demonstrate an apolar staining pattern (Diaz et al, The Breast Journal, 7; 40-45 (2001); Zhang et al, Clinical Cancer Research, 4; 2669-2676 (1998): Cao, et al, The Journal of Histochemistry and Cytochemistry, 45: 1547-1557 (1997)). In addition, normal breast epithelium is either negative for Her2 protein or exhibits only a basolateral distribution whereas malignant cells can express the protein over the whole cell surface (De Potter, et al, International Journal of Cancer, 44; 969-974 (1989): McCormick, et al, 117; 935-943 (2002)). Alternatively, distribution of the protein may be altered from a surface only localization to include diffuse cytoplasmic expression in the diseased state. Such an example can be seen with MUC1 (Diaz, et al, The Breast Journal, 7: 40-45 (2001)).

Alteration in the localization/distribution of a protein in the cell, as detected by immunohistochemical methods, can also provide valuable information concerning the favorability of certain treatment modalities. This last point is illustrated by a situation where a protein may be intracellular in normal tissue, but cell surface in malignant cells; the cell surface location makes the cells favorably amenable to antibody-based diagnostic and treatment regimens. When such an alteration of protein localization occurs for 158P3D2, the 158P3D2 protein and immune responses related thereto are very useful. Accordingly, the ability to determine whether alteration of subcellular protein localization occurred for 24P4C12 make the 158P3D2 protein and immune responses related thereto very useful. Use of the 158P3D2 compositions allows those skilled in the art to make important diagnostic and therapeutic decisions.

Immunohistochemical reagents specific to 158P3D2 are also useful to detect metastases of tumors expressing 158P3D2 when the polypeptide appears in tissues where 158P3D2 is not normally produced.

Thus, 158P3D2 polypeptides and antibodies resulting from immune responses thereto are useful in a variety of important contexts such as diagnostic, prognostic, preventative and/or therapeutic purposes known to those skilled in the art.

Just as PSA polynucleotide fragments and polynucleotide variants are employed by skilled artisans for use in methods of monitoring PSA, 158P3D2 polynucleotide fragments and polynucleotide variants are used in an analogous manner. In particular, typical PSA polynucleotides used in methods of monitoring PSA are probes or primers which consist of fragments of the PSA cDNA sequence. Illustrating this, primers used to PCR amplify a PSA polynucleotide must include less than the whole PSA sequence to function in the polymerase chain reaction. In the context of such PCR reactions, skilled artisans generally create a variety of different polynucleotide fragments that can be used as primers in order to amplify different portions of a polynucleotide of interest or to optimize amplification reactions (see, e.g., Caetano-Anolles, G. Biotechniques 25(3): 472-476, 478-480 (1998); Robertson et al., Methods Mol. Biol. 98:121-154 (1998)). An additional illustration of the use of such fragments is provided in the Example entitled "Expression analysis of 158P3D2 in normal tissues, and patient specimens," where a 158P3D2 polynucleotide fragment is used as a probe to show the expression of 158P3D2 RNAs in cancer cells. In addition, variant polynucleotide sequences are typically used as primers and probes for the corresponding mRNAs in PCR and Northern analyses (see, e.g., Sawai et al., Fetal Diagn. Ther. 1996 Nov.-Dec. 11 (6):407-13 and Current Protocols In Molecular Biology, Volume 2, Unit 2, Frederick M. Ausubel et al. eds., 1995)). Polynucleotide fragments and variants are useful in this context where they are capable of binding to a target polynucleotide sequence (e.g., a 158P3D2 polynucleotide shown in FIG. 2 or variant thereof) under conditions of high stringency.

Furthermore, PSA polypeptides which contain an epitope that can be recognized by an antibody or T cell that specifically binds to that epitope are used in methods of monitoring PSA. 158P3D2 polypeptide fragments and polypeptide analogs or variants can also be used in an analogous manner. This practice of using polypeptide fragments or polypeptide variants to generate antibodies (such as anti-PSA antibodies or T cells) is typical in the art with a wide variety of systems such as fusion proteins being used by practitioners (see, e.g., Current Protocols In Molecular Biology, Volume 2, Unit 16, Frederick M. Ausubel et al. eds., 1995). In this context, each epitope(s) functions to provide the architecture with which an antibody or T cell is reactive. Typically, skilled artisans create a variety of different polypeptide fragments that can be used in order to generate immune responses specific for different portions of a polypeptide of interest (see, e.g., U.S. Pat. No. 5,840,501 and U.S. Pat. No. 5,939,533). For example it may be preferable to utilize a polypeptide comprising one of the 158P3D2 biological motifs discussed herein or a motif-bearing subsequence which is readily identified by one of skill in the art based on motifs available in the art. Polypeptide fragments, variants or analogs are typically useful in this context as long as they comprise an epitope capable of generating an antibody or T cell specific for a target polypeptide sequence (e.g. a 158P3D2 polypeptide shown in FIG. 3).

As shown herein, the 158P3D2 polynucleotides and polypeptides (as well as the 158P3D2 polynucleotide probes and anti-158P3D2 antibodies or T cells used to identify the presence of these molecules) exhibit specific properties that make them useful in diagnosing cancers such as those listed in Table I. Diagnostic assays that measure the presence of 158P3D2 gene products, in order to evaluate the presence or onset of a disease condition described herein, such as prostate cancer, are used to identify patients for preventive measures or further monitoring, as has been done so successfully with PSA. Moreover, these materials satisfy a need in the art for molecules having similar or complementary characteristics to PSA in situations where, for example, a definite diagnosis of metastasis of prostatic origin cannot be made on the basis of a test for PSA alone (see, e.g., Alanen et al., Pathol. Res. Pract. 192(3): 233-237 (1996)), and consequently, materials such as 158P3D2 polynucleotides and polypeptides (as well as the 158P3D2 polynucleotide probes and anti-158P3D2 antibodies used to identify the presence of these molecules) need to be employed to confirm a metastases of prostatic origin.

Finally, in addition to their use in diagnostic assays, the 158P3D2 polynucleotides disclosed herein have a number of other utilities such as their use in the identification of oncogenetic associated chromosomal abnormalities in the chromosomal region to which the 158P3D2 gene maps (see the Example entitled "Chromosomal Mapping of 158P3D2" below). Moreover, in addition to their use in diagnostic assays, the 158P3D2-related proteins and polynucleotides disclosed herein have other utilities such as their use in the forensic analysis of tissues of unknown origin (see, e.g., Takahama K Forensic Sci Int 1996 Jun. 28; 80(1-2): 63-9).

Additionally, 158P3D2-related proteins or polynucleotides of the invention can be used to treat a pathologic condition characterized by the over-expression of 158P3D2. For example, the amino acid or nucleic acid sequence of FIG. 2 or FIG. 3, or fragments of either, can be used to generate an immune response to a 158P3D2 antigen. Antibodies or other molecules that react with 158P3D2 can be used to modulate the function of this molecule, and thereby provide a therapeutic benefit.

XII.) INHIBITION OF 158P3D2 PROTEIN FUNCTION

The invention includes various methods and compositions for inhibiting the binding of 158P3D2 to its binding partner or its association with other protein(s) as well as methods for inhibiting 158P3D2 function.

XII.A.) Inhibition of 158P3D2 with Intracellular Antibodies

In one approach, a recombinant vector that encodes single chain antibodies that specifically bind to 158P3D2 are introduced into 158P3D2 expressing cells via gene transfer technologies. Accordingly, the encoded single chain anti-158P3D2 antibody is expressed intracellularly, binds to 158P3D2 protein, and thereby inhibits its function. Methods for engineering such intracellular single chain antibodies are well known. Such intracellular antibodies, also known as "intrabodies", are specifically targeted to a particular compartment within the cell, providing control over where the inhibitory activity of the treatment is focused. This technology has been successfully applied in the art (for review, see Richardson and Marasco, 1995, TIBTECH vol. 13). Intrabodies have been shown to virtually eliminate the expression of otherwise abundant cell surface receptors (see, e.g., Richardson et al., 1995, Proc. Natl. Acad. Sci. USA 92: 3137-3141; Beerli et al., 1994, J. Biol. Chem. 289: 23931-23936; Deshane et al., 1994, Gene Ther. 1: 332-337).

Single chain antibodies comprise the variable domains of the heavy and light chain joined by a flexible linker polypeptide, and are expressed as a single polypeptide. Optionally, single chain antibodies are expressed as a single chain variable region fragment joined to the light chain constant region. Well-known intracellular trafficking signals are engineered into recombinant polynucleotide vectors encoding such single chain antibodies in order to target precisely the intrabody to the desired intracellular compartment. For example, intrabodies targeted to the endoplasmic reticulum (ER) are engineered to incorporate a leader peptide and, optionally, a C-terminal ER retention signal, such as the KDEL amino acid motif. Intrabodies intended to exert activity in the nucleus are engineered to include a nuclear localization signal. Lipid moieties are joined to intrabodies in order to tether the intrabody to the cytosolic side of the plasma membrane. Intrabodies can also be targeted to exert function in the cytosol. For example, cytosolic intrabodies are used to sequester factors within the cytosol, thereby preventing them from being transported to their natural cellular destination.

In one embodiment, intrabodies are used to capture 158P3D2 in the nucleus, thereby preventing its activity within the nucleus. Nuclear targeting signals are engineered into such 158P3D2 intrabodies in order to achieve the desired targeting. Such 158P3D2 intrabodies are designed to bind specifically to a particular 158P3D2 domain. In another embodiment, cytosolic intrabodies that specifically bind to a 158P3D2 protein are used to prevent 158P3D2 from gaining access to the nucleus, thereby preventing it from exerting any biological activity within the nucleus (e.g., preventing 158P3D2 from forming transcription complexes with other factors).

In order to specifically direct the expression of such intrabodies to particular cells, the transcription of the intrabody is placed under the regulatory control of an appropriate tumor-specific promoter and/or enhancer. In order to target intrabody expression specifically to prostate, for example, the PSA promoter and/or promoter/enhancer can be utilized (See, for example, U.S. Pat. No. 5,919,652 issued 6 Jul. 1999).

XII.B.) Inhibition of 158P3D2 with Recombinant Proteins

In another approach, recombinant molecules bind to 158P3D2 and thereby inhibit 158P3D2 function. For example, these recombinant molecules prevent or inhibit 158P3D2 from accessing/binding to its binding partner(s) or associating with other protein(s). Such recombinant molecules can, for example, contain the reactive part(s) of a 158P3D2 specific antibody molecule. In a particular embodiment, the 158P3D2 binding domain of a 158P3D2 binding partner is engineered into a dimeric fusion protein, whereby the fusion protein comprises two 158P3D2 ligand binding domains linked to the Fc portion of a human IgG, such as human IgG1. Such IgG portion can contain, for example, the CH2 and CH3 domains and the hinge region, but not the CH1 domain. Such dimeric fusion proteins are administered in soluble form to patients suffering from a cancer associated with the expression of 158P3D2, whereby the dimeric fusion protein specifically binds to 158P3D2 and blocks 158P3D2 interaction with a binding partner. Such dimeric fusion proteins are further combined into multimeric proteins using known antibody linking technologies.

XII.C.) Inhibition of 158P3D2 Transcription or Translation

The present invention also comprises various methods and compositions for inhibiting the transcription of the 158P3D2 gene. Similarly, the invention also provides methods and compositions for inhibiting the translation of 158P3D2 mRNA into protein.

In one approach, a method of inhibiting the transcription of the 158P3D2 gene comprises contacting the 158P3D2 gene with a 158P3D2 antisense polynucleotide. In another approach, a method of inhibiting 158P3D2 mRNA translation comprises contacting a 158P3D2 mRNA with an antisense polynucleotide. In another approach, a 158P3D2 specific ribozyme is used to cleave a 158P3D2 message, thereby inhibiting translation. Such antisense and ribozyme based methods can also be directed to the regulatory regions of the 158P3D2 gene, such as 158P3D2 promoter and/or enhancer elements. Similarly, proteins capable of inhibiting a 158P3D2 gene transcription factor are used to inhibit 158P3D2 mRNA transcription. The various polynucleotides and compositions useful in the aforementioned methods have been described above. The use of antisense and ribozyme molecules to inhibit transcription and translation is well known in the art.

Other factors that inhibit the transcription of 158P3D2 by interfering with 158P3D2 transcriptional activation are also useful to treat cancers expressing 158P3D2. Similarly, factors that interfere with 158P3D2 processing are useful to treat cancers that express 158P3D2. Cancer treatment methods utilizing such factors are also within the scope of the invention.

XII.D.) General Considerations for Therapeutic Strategies

Gene transfer and gene therapy technologies can be used to deliver therapeutic polynucleotide molecules to tumor cells synthesizing 158P3D2 (i.e., antisense, ribozyme, polynucleotides encoding intrabodies and other 158P3D2 inhibitory molecules). A number of gene therapy approaches are known in the art. Recombinant vectors encoding 158P3D2 antisense polynucleotides, ribozymes, factors capable of interfering with 158P3D2 transcription, and so forth, can be delivered to target tumor cells using such gene therapy approaches.

The above therapeutic approaches can be combined with any one of a wide variety of surgical, chemotherapy or radiation therapy regimens. The therapeutic approaches of the invention can enable the use of reduced dosages of chemotherapy (or other therapies) and/or less frequent administration, an advantage for all patients and particularly for those that do not tolerate the toxicity of the chemotherapeutic agent well.

The anti-tumor activity of a particular composition (e.g., antisense, ribozyme, intrabody), or a combination of such compositions, can be evaluated using various in vitro and in vivo assay systems. In vitro assays that evaluate therapeutic activity include cell growth assays, soft agar assays and other assays indicative of tumor promoting activity, binding assays capable of determining the extent to which a therapeutic composition will inhibit the binding of 158P3D2 to a binding partner, etc.

In vivo, the effect of a 158P3D2 therapeutic composition can be evaluated in a suitable animal model. For example, xenogenic prostate cancer models can be used, wherein human prostate cancer explants or passaged xenograft tissues are introduced into immune compromised animals, such as nude or SCID mice (Klein et al., 1997, Nature Medicine 3: 402-408). For example, PCT Patent Application WO98/16628 and U.S. Pat. No. 6,107,540 describe various xenograft models of human prostate cancer capable of recapitulating the development of primary tumors, micrometastasis, and the formation of osteoblastic metastases characteristic of late stage disease. Efficacy can be predicted using assays that measure inhibition of tumor formation, tumor regression or metastasis, and the like.

In vivo assays that evaluate the promotion of apoptosis are useful in evaluating therapeutic compositions. In one embodiment, xenografts from tumor bearing mice treated with the therapeutic composition can be examined for the presence of apoptotic foci and compared to untreated control xenograft-bearing mice. The extent to which apoptotic foci are found in the tumors of the treated mice provides an indication of the therapeutic efficacy of the composition.

The therapeutic compositions used in the practice of the foregoing methods can be formulated into pharmaceutical compositions comprising a carrier suitable for the desired delivery method. Suitable carriers include any material that when combined with the therapeutic composition retains the anti-tumor function of the therapeutic composition and is generally non-reactive with the patient's immune system. Examples include, but are not limited to, any of a number of standard pharmaceutical carriers such as sterile phosphate buffered saline solutions, bacteriostatic water, and the like (see, generally, Remington's Pharmaceutical Sciences 16th Edition, A. Osal., Ed., 1980).

Therapeutic formulations can be solubilized and administered via any route capable of delivering the therapeutic composition to the tumor site. Potentially effective routes of administration include, but are not limited to, intravenous, parenteral, intraperitoneal, intramuscular, intratumor, intradermal, intraorgan, orthotopic, and the like. A preferred formulation for intravenous injection comprises the therapeutic composition in a solution of preserved bacteriostatic water, sterile unpreserved water, and/or diluted in polyvinylchloride or polyethylene bags containing 0.9% sterile Sodium Chloride for Injection, USP. Therapeutic protein preparations can be lyophilized and stored as sterile powders, preferably under vacuum, and then reconstituted in bacteriostatic water (containing for example, benzyl alcohol preservative) or in sterile water prior to injection.

Dosages and administration protocols for the treatment of cancers using the foregoing methods will vary with the method and the target cancer, and will generally depend on a number of other factors appreciated in the art.

XIII.) IDENTIFICATION, CHARACTERIZATION AND USE OF MODULATORS OF 158P3D2

XIII.A.) Methods to Identify and Use Modulators

In one embodiment, screening is performed to identify modulators that induce or suppress a particular expression profile, suppress or induce specific pathways, preferably generating the associated phenotype thereby. In another embodiment, having identified differentially expressed genes important in a particular state; screens are performed to identify modulators that alter expression of individual genes, either increase or decrease. In another embodiment, screening is performed to identify modulators that alter a biological function of the expression product of a differentially expressed gene. Again, having identified the importance of a gene in a particular state, screens are performed to identify agents that bind and/or modulate the biological activity of the gene product.

In addition, screens are done for genes that are induced in response to a candidate agent. After identifying a modulator (one that suppresses a cancer expression pattern leading to a normal expression pattern, or a modulator of a cancer gene that leads to expression of the gene as in normal tissue) a screen is performed to identify genes that are specifically modulated in response to the agent. Comparing expression profiles between normal tissue and agent-treated cancer tissue reveals genes that are not expressed in normal tissue or cancer tissue, but are expressed in agent treated tissue, and vice versa. These agent-specific sequences are identified and used by methods described herein for cancer genes or proteins. In particular these sequences and the proteins they encode are used in marking or identifying agent-treated cells. In addition, antibodies are raised against the agent-induced proteins and used to target novel therapeutics to the treated cancer tissue sample.

XIII.B.) Gene Expression-Related Assays

Proteins, nucleic acids, and antibodies of the invention are used in screening assays. The cancer-associated proteins, antibodies, nucleic acids, modified proteins and cells containing these sequences are used in screening assays, such as evaluating the effect of drug candidates on a "gene expression profile," expression profile of polypeptides or alteration of biological function. In one embodiment, the expression profiles are used, preferably in conjunction with high throughput screening techniques to allow monitoring for expression profile genes after treatment with a candidate agent (e.g., Davis, G F, et al, J Biol Screen 7:69 (2002); Zlokarnik, et al., Science 279:84-8 (1998); Heid, Genome Res 6:986-94, 1996).

The cancer proteins, antibodies, nucleic acids, modified proteins and cells containing the native or modified cancer proteins or genes are used in screening assays. That is, the present invention comprises methods for screening for compositions which modulate the cancer phenotype or a physiological function of a cancer protein of the invention. This is done on a gene itself or by evaluating the effect of drug candidates on a "gene expression profile" or biological function. In one embodiment, expression profiles are used, preferably in conjunction with high throughput screening techniques to allow monitoring after treatment with a candidate agent, see Zlokamik, supra.

A variety of assays are executed directed to the genes and proteins of the invention. Assays are run on an individual nucleic acid or protein level. That is, having identified a particular gene as up regulated in cancer, test compounds are screened for the ability to modulate gene expression or for binding to the cancer protein of the invention. "Modulation" in this context includes an increase or a decrease in gene expression. The preferred amount of modulation will depend on the original change of the gene expression in normal versus tissue undergoing cancer, with changes of at least 10%, preferably 50%, more preferably 100-300%, and in some embodiments 300-1000% or greater. Thus, if a gene exhibits a 4-fold increase in cancer tissue compared to normal tissue, a decrease of about four-fold is often desired; similarly, a 10-fold decrease in cancer tissue compared to normal tissue a target value of a 10-fold increase in expression by the test compound is often desired. Modulators that exacerbate the type of gene expression seen in cancer are also useful, e.g., as an upregulated target in further analyses.

The amount of gene expression is monitored using nucleic acid probes and the quantification of gene expression levels, or, alternatively, a gene product itself is monitored, e.g., through the use of antibodies to the cancer protein and standard immunoassays. Proteomics and separation techniques also allow for quantification of expression.

XIII.C.) Expression Monitoring to Identify Compounds that Modify Gene Expression In one embodiment, gene expression monitoring, i.e., an expression profile, is monitored simultaneously for a number of entities. Such profiles will typically involve one or more of the genes of FIG. 2. In this embodiment, e.g., cancer nucleic acid probes are attached to biochips to detect and quantify cancer sequences in a particular cell. Alternatively, PCR can be used. Thus, a series, e.g., wells of a microtiter plate, can be used with dispensed primers in desired wells. A PCR reaction can then be performed and analyzed for each well.

Expression monitoring is performed to identify compounds that modify the expression of one or more cancer-associated sequences, e.g., a polynucleotide sequence set out in FIG. 2. Generally, a test modulator is added to the cells prior to analysis. Moreover, screens are also provided to identify agents that modulate cancer, modulate cancer proteins of the invention, bind to a cancer protein of the invention, or interfere with the binding of a cancer protein of the invention and an antibody or other binding partner.

In one embodiment, high throughput screening methods involve providing a library containing a large number of potential therapeutic compounds (candidate compounds). Such "combinatorial chemical libraries" are then screened in one or more assays to identify those library members (particular chemical species or subclasses) that display a desired characteristic activity. The compounds thus identified can serve as conventional "lead compounds," as compounds for screening, or as therapeutics.

In certain embodiments, combinatorial libraries of potential modulators are screened for an ability to bind to a cancer polypeptide or to modulate activity. Conventionally, new chemical entities with useful properties are generated by identifying a chemical compound (called a "lead compound") with some desirable property or activity, e.g., inhibiting activity, creating variants of the lead compound, and evaluating the property and activity of those variant compounds. Often, high throughput screening (HTS) methods are employed for such an analysis.

As noted above, gene expression monitoring is conveniently used to test candidate modulators (e.g., protein, nucleic acid or small molecule). After the candidate agent has been added and the cells allowed to incubate for a period, the sample containing a target sequence to be analyzed is, e.g., added to a biochip.

If required, the target sequence is prepared using known techniques. For example, a sample is treated to lyse the cells, using known lysis buffers, electroporation, etc., with purification and/or amplification such as PCR performed as appropriate. For example, an in vitro transcription with labels covalently attached to the nucleotides is performed. Generally, the nucleic acids are labeled with biotin-FITC or PE, or with cy3 or cy5.

The target sequence can be labeled with, e.g., a fluorescent, a chemiluminescent, a chemical, or a radioactive signal, to provide a means of detecting the target sequence's specific binding to a probe. The label also can be an enzyme, such as alkaline phosphatase or horseradish peroxidase, which when provided with an appropriate substrate produces a product that is detected. Alternatively, the label is a labeled compound or small molecule, such as an enzyme inhibitor, that binds but is not catalyzed or altered by the enzyme. The label also can be a moiety or compound, such as, an epitope tag or biotin which specifically binds to streptavidin. For the example of biotin, the streptavidin is labeled as described above, thereby, providing a detectable signal for the bound target sequence. Unbound labeled streptavidin is typically removed prior to analysis.

As will be appreciated by those in the art, these assays can be direct hybridization assays or can comprise "sandwich assays", which include the use of multiple probes, as is generally outlined in U.S. Pat. Nos. 5,681,702; 5,597,909; 5,545,730; 5,594,117; 5,591,584; 5,571,670; 5,580,731; 5,571,670; 5,591,584; 5,624,802; 5,635,352; 5,594,118; 5,359,100; 5,124,246; and 5,681,697. In this embodiment, in general, the target nucleic acid is prepared as outlined above, and then added to the biochip comprising a plurality of nucleic acid probes, under conditions that allow the formation of a hybridization complex.

A variety of hybridization conditions are used in the present invention, including high, moderate and low stringency conditions as outlined above. The assays are generally run under stringency conditions which allow formation of the label probe hybridization complex only in the presence of target. Stringency can be controlled by altering a step parameter that is a thermodynamic variable, including, but not limited to, temperature, formamide concentration, salt concentration, chaotropic salt concentration pH, organic solvent concentration, etc. These parameters may also be used to control non-specific binding, as is generally outlined in U.S. Pat. No. 5,681,697. Thus, it can be desirable to perform certain steps at higher stringency conditions to reduce non-specific binding.

The reactions outlined herein can be accomplished in a variety of ways. Components of the reaction can be added simultaneously, or sequentially, in different orders, with preferred embodiments outlined below. In addition, the reaction may include a variety of other reagents. These include salts, buffers, neutral proteins, e.g. albumin, detergents, etc. which can be used to facilitate optimal hybridization and detection, and/or reduce nonspecific or background interactions. Reagents that otherwise improve the efficiency of the assay, such as protease inhibitors, nuclease inhibitors, anti-microbial agents, etc., may also be used as appropriate, depending on the sample preparation methods and purity of the target. The assay data are analyzed to determine the expression levels of individual genes, and changes in expression levels as between states, forming a gene expression profile.

XIII.D.) Biological Activity-Related Assays

The invention provides methods identify or screen for a compound that modulates the activity of a cancer-related gene or protein of the invention. The methods comprise adding a test compound, as defined above, to a cell comprising a cancer protein of the invention. The cells contain a recombinant nucleic acid that encodes a cancer protein of the invention. In another embodiment, a library of candidate agents is tested on a plurality of cells.

In one aspect, the assays are evaluated in the presence or absence or previous or subsequent exposure of physiological signals, e.g. hormones, antibodies, peptides, antigens, cytokines, growth factors, action potentials, pharmacological agents including chemotherapeutics, radiation, carcinogenics, or other cells (i.e., cell-cell contacts). In another example, the determinations are made at different stages of the cell cycle process. In this way, compounds that modulate genes or proteins of the invention are identified. Compounds with pharmacological activity are able to enhance or interfere with the activity of the cancer protein of the invention. Once identified, similar structures are evaluated to identify critical structural features of the compound.

In one embodiment, a method of modulating (e.g., inhibiting) cancer cell division is provided; the method comprises administration of a cancer modulator. In another embodiment, a method of modulating (e.g., inhibiting) cancer is provided; the method comprises administration of a cancer modulator. In a further embodiment, methods of treating cells or individuals with cancer are provided; the method comprises administration of a cancer modulator.

In one embodiment, a method for modulating the status of a cell that expresses a gene of the invention is provided. As used herein status comprises such art-accepted parameters such as growth, proliferation, survival, function, apoptosis, senescence, location, enzymatic activity, signal transduction, etc. of a cell. In one embodiment, a cancer inhibitor is an antibody as discussed above. In another embodiment, the cancer inhibitor is an antisense molecule. A variety of cell growth, proliferation, and metastasis assays are known to those of skill in the art, as described herein.

XIII.E.) High Throuhput Screening to Identify Modulators

The assays to identify suitable modulators are amenable to high throughput screening. Preferred assays thus detect enhancement or inhibition of cancer gene transcription, inhibition or enhancement of polypeptide expression, and inhibition or enhancement of polypeptide activity.

In one embodiment, modulators evaluated in high throughput screening methods are proteins, often naturally occurring proteins or fragments of naturally occurring proteins. Thus, e.g., cellular extracts containing proteins, or random or directed digests of proteinaceous cellular extracts, are used. In this way, libraries of proteins are made for screening in the methods of the invention. Particularly preferred in this embodiment are libraries of bacterial, fungal, viral, and mammalian proteins, with the latter being preferred, and human proteins being especially preferred. Particularly useful test compound will be directed to the class of proteins to which the target belongs, e.g., substrates for enzymes, or ligands and receptors.

XIII.F.) Use of Soft Agar Growth and Colony Formation to Identify and Characterize Modulators Normal cells require a solid substrate to attach and grow. When cells are transformed, they lose this phenotype and grow detached from the substrate. For example, transformed cells can grow in stirred suspension culture or suspended in semi-solid media, such as semi-solid or soft agar. The transformed cells, when transfected with tumor suppressor genes, can regenerate normal phenotype and once again require a solid substrate to attach to and grow. Soft agar growth or colony formation in assays are used to identify modulators of cancer sequences, which when expressed in host cells, inhibit abnormal cellular proliferation and transformation. A modulator reduces or eliminates the host cells' ability to grow suspended in solid or semisolid media, such as agar.

Techniques for soft agar growth or colony formation in suspension assays are described in Freshney, Culture of Animal Cells a Manual of Basic Technique (3rd ed., 1994). See also, the methods section of Garkavtsev et al. (1996), supra.

XIII.G.) Evaluation of Contact Inhibition and Growth Density Limitation to Identify and Characterize Modulators Normal cells typically grow in a flat and organized pattern in cell culture until they touch other cells. When the cells touch one another, they are contact inhibited and stop growing. Transformed cells, however, are not contact inhibited and continue to grow to high densities in disorganized foci. Thus, transformed cells grow to a higher saturation density than corresponding normal cells. This is detected morphologically by the formation of a disoriented monolayer of cells or cells in foci. Alternatively, labeling index with (3H)-thymidine at saturation density is used to measure density limitation of growth, similarly an MTT or Alamar blue assay will reveal proliferation capacity of cells and the ability of modulators to affect same. See Freshney (1994), supra. Transformed cells, when transfected with tumor suppressor genes, can regenerate a normal phenotype and become contact inhibited and would grow to a lower density.

In this assay, labeling index with 3H)-thymidine at saturation density is a preferred method of measuring density limitation of growth. Transformed host cells are transfected with a cancer-associated sequence and are grown for 24 hours at saturation density in non-limiting medium conditions. The percentage of cells labeling with (3H)-thymidine is determined by incorporated cpm.

Contact independent growth is used to identify modulators of cancer sequences, which had led to abnormal cellular proliferation and transformation. A modulator reduces or eliminates contact independent growth, and returns the cells to a normal phenotype.

XIII.H.) Evaluation of Growth Factor or Serum Dependence to Identify and Characterize Modulators Transformed cells have lower serum dependence than their normal counterparts (see, e.g., Temin, J. Natl. Cancer Inst. 37:167-175 (1966); Eagle et al., J. Exp. Med 131:836-879 (1970)); Freshney, supra. This is in part due to release of various growth factors by the transformed cells. The degree of growth factor or serum dependence of transformed host cells can be compared with that of control. For example, growth factor or serum dependence of a cell is monitored in methods to identify and characterize compounds that modulate cancer-associated sequences of the invention.

XIII.I.) Use of Tumor-Specific Marker Levels to Identify and Characterize Modulators Tumor cells release an increased amount of certain factors (hereinafter "tumor specific markers") than their normal counterparts. For example, plasminogen activator (PA) is released from human glioma at a higher level than from normal brain cells (see, e.g., Gullino, Angiogenesis, Tumor Vascularization, and Potential Interference with Tumor Growth, in Biological Responses in Cancer, pp. 178-184 (Mihich (ed.) 1985)). Similarly, Tumor Angiogenesis Factor (TAF) is released at a higher level in tumor cells than their normal counterparts. See, e.g., Folkman, Angiogenesis and Cancer, Sem Cancer Biol. (1992)), while bFGF is released from endothelial tumors (Ensoli, B et al).

Various techniques which measure the release of these factors are described in Freshney (1994), supra. Also, see, Unkless et al., J. Biol. Chem. 249:4295-4305 (1974); Strickland & Beers, J. Biol. Chem. 251:5694-5702 (1976); Whur et al., Br. J. Cancer 42:305 312 (1980); Gullino, Angiogenesis, Tumor Vascularization, and Potential Interference with Tumor Growth, in Biological Responses in Cancer, pp. 178-184 (Mihich (ed.) 1985); Freshney, Anticancer Res. 5:111-130 (1985). For example, tumor specific marker levels are monitored in methods to identify and characterize compounds that modulate cancer-associated sequences of the invention.

XIII.J.) Invasiveness into Matrigel to Identify and Characterize Modulators

The degree of invasiveness into Matrigel or an extracellular matrix constituent can be used as an assay to identify and characterize compounds that modulate cancer associated sequences. Tumor cells exhibit a positive correlation between malignancy and invasiveness of cells into Matrigel or some other extracellular matrix constituent. In this assay, tumorigenic cells are typically used as host cells. Expression of a tumor suppressor gene in these host cells would decrease invasiveness of the host cells. Techniques described in Cancer Res. 1999; 59:6010; Freshney (1994), supra, can be used. Briefly, the level of invasion of host cells is measured by using filters coated with Matrigel or some other extracellular matrix constituent. Penetration into the gel, or through to the distal side of the filter, is rated as invasiveness, and rated histologically by number of cells and distance moved, or by prelabeling the cells with 1251 and counting the radioactivity on the distal side of the filter or bottom of the dish. See, e.g., Freshney (1984), supra.

XIII.K.) Evaluation of Tumor Growth In Vivo to Identify and Characterize Modulators Effects of cancer-associated sequences on cell growth are tested in transgenic or immune-suppressed organisms. Transgenic organisms are prepared in a variety of art-accepted ways. For example, knock-out transgenic organisms, e.g., mammals such as mice, are made, in which a cancer gene is disrupted or in which a cancer gene is inserted. Knock-out transgenic mice are made by insertion of a marker gene or other heterologous gene into the endogenous cancer gene site in the mouse genome via homologous recombination. Such mice can also be made by substituting the endogenous cancer gene with a mutated version of the cancer gene, or by mutating the endogenous cancer gene, e.g., by exposure to carcinogens.

To prepare transgenic chimeric animals, e.g., mice, a DNA construct is introduced into the nuclei of embryonic stem cells. Cells containing the newly engineered genetic lesion are injected into a host mouse embryo, which is re-implanted into a recipient female. Some of these embryos develop into chimeric mice that possess germ cells some of which are derived from the mutant cell line. Therefore, by breeding the chimeric mice it is possible to obtain a new line of mice containing the introduced genetic lesion (see, e.g., Capecchi et al., Science 244:1288 (1989)). Chimeric mice can be derived according to U.S. Pat. No. 6,365,797, issued 2 Apr. 2002; U.S. Pat. No. 6,107,540 issued 22 Aug. 2000; Hogan et al., Manipulating the Mouse Embryo: A laboratory Manual, Cold Spring Harbor Laboratory (1988) and Teratocarcinomas and Embryonic Stem Cells: A Practical Approach, Robertson, ed., IRL Press, Washington, D.C., (1987).

Alternatively, various immune-suppressed or immune-deficient host animals can be used. For example, a genetically athymic "nude" mouse (see, e.g., Giovanella et al., J. Natl. Cancer Inst. 52:921 (1974)), a SCID mouse, a thymectornized mouse, or an irradiated mouse (see, e.g., Bradley et al., Br. J. Cancer 38:263 (1978); Selby et al., Br. J. Cancer 41:52 (1980)) can be used as a host. Transplantable tumor cells (typically about 106 cells) injected into isogenic hosts produce invasive tumors in a high proportion of cases, while normal cells of similar origin will not. In hosts which developed invasive tumors, cells expressing cancer-associated sequences are injected subcutaneously or orthotopically. Mice are then separated into groups, including control groups and treated experimental groups) e.g. treated with a modulator). After a suitable length of time, preferably 4-8 weeks, tumor growth is measured (e.g., by volume or by its two largest dimensions, or weight) and compared to the control. Tumors that have statistically significant reduction (using, e.g., Student's T test) are said to have inhibited growth.

XIII.L.) In Vitro Assays to Identify and Characterize Modulators

Assays to identify compounds with modulating activity can be performed in vitro. For example, a cancer polypeptide is first contacted with a potential modulator and incubated for a suitable amount of time, e.g., from 0.5 to 48 hours. In one embodiment, the cancer polypeptide levels are determined in vitro by measuring the level of protein or mRNA. The level of protein is measured using immunoassays such as Western blotting, ELISA and the like with an antibody that selectively binds to the cancer polypeptide or a fragment thereof. For measurement of mRNA, amplification, e.g., using PCR, LCR, or hybridization assays, e.g., Northern hybridization, RNAse protection, dot blotting, are preferred. The level of protein or mRNA is detected using directly or indirectly labeled detection agents, e.g., fluorescently or radioactively labeled nucleic acids, radioactively or enzymatically labeled antibodies, and the like, as described herein.

Alternatively, a reporter gene system can be devised using a cancer protein promoter operably linked to a reporter gene such as luciferase, green fluorescent protein, CAT, or P-gal. The reporter construct is typically transfected into a cell. After treatment with a potential modulator, the amount of reporter gene transcription, translation, or activity is measured according to standard techniques known to those of skill in the art (Davis G F, supra; Gonzalez, J. & Negulescu, P. Curr. Opin. Biotechnol. 1998: 9:624).

As outlined above, in vitro screens are done on individual genes and gene products. That is, having identified a particular differentially expressed gene as important in a particular state, screening of modulators of the expression of the gene or the gene product itself is performed.

In one embodiment, screening for modulators of expression of specific gene(s) is performed. Typically, the expression of only one or a few genes is evaluated. In another embodiment, screens are designed to first find compounds that bind to differentially expressed proteins. These compounds are then evaluated for the ability to modulate differentially expressed activity. Moreover, once initial candidate compounds are identified, variants can be further screened to better evaluate structure activity relationships.

XIII.M.) Binding Assays to Identify and Characterize Modulators

In binding assays in accordance with the invention, a purified or isolated gene product of the invention is generally used. For example, antibodies are generated to a protein of the invention, and immunoassays are run to determine the amount and/or location of protein. Alternatively, cells comprising the cancer proteins are used in the assays.

Thus, the methods comprise combining a cancer protein of the invention and a candidate compound such as a ligand, and determining the binding of the compound to the cancer protein of the invention. Preferred embodiments utilize the human cancer protein; animal models of human disease of can also be developed and used. Also, other analogous mammalian proteins also can be used as appreciated by those of skill in the art. Moreover, in some embodiments variant or derivative cancer proteins are used.

Generally, the cancer protein of the invention, or the ligand, is non-diffusibly bound to an insoluble support. The support can, e.g., be one having isolated sample receiving areas (a microtiter plate, an array, etc.). The insoluble supports can be made of any composition to which the compositions can be bound, is readily separated from soluble material, and is otherwise compatible with the overall method of screening. The surface of such supports can be solid or porous and of any convenient shape.

Examples of suitable insoluble supports include microtiter plates, arrays, membranes and beads. These are typically made of glass, plastic (e.g., polystyrene), polysaccharide, nylon, nitrocellulose, or Teflon™, etc. Microtiter plates and arrays are especially convenient because a large number of assays can be carried out simultaneously, using small amounts of reagents and samples. The particular manner of binding of the composition to the support is not crucial so long as it is compatible with the reagents and overall methods of the invention, maintains the activity of the composition and is nondiffusable. Preferred methods of binding include the use of antibodies which do not sterically block either the ligand binding site or activation sequence when attaching the protein to the support, direct binding to "sticky" or ionic supports, chemical crosslinking, the synthesis of the protein or agent on the surface, etc. Following binding of the protein or ligand/binding agent to the support, excess unbound material is removed by washing. The sample receiving areas may then be blocked through incubation with bovine serum albumin (BSA), casein or other innocuous protein or other moiety.

Once a cancer protein of the invention is bound to the support, and a test compound is added to the assay. Alternatively, the candidate binding agent is bound to the support and the cancer protein of the invention is then added. Binding agents include specific antibodies, non-natural binding agents identified in screens of chemical libraries, peptide analogs, etc.

Of particular interest are assays to identify agents that have a low toxicity for human cells. A wide variety of assays can be used for this purpose, including proliferation assays, cAMP assays, labeled in vitro protein-protein binding assays, electrophoretic mobility shift assays, immunoassays for protein binding, functional assays (phosphorylation assays, etc.) and the like.

A determination of binding of the test compound (ligand, binding agent, modulator, etc.) to a cancer protein of the invention can be done in a number of ways. The test compound can be labeled, and binding determined directly, e.g., by attaching all or a portion of the cancer protein of the invention to a solid support, adding a labeled candidate compound (e.g., a fluorescent label), washing off excess reagent, and determining whether the label is present on the solid support. Various blocking and washing steps can be utilized as appropriate.

In certain embodiments, only one of the components is labeled, e.g., a protein of the invention or ligands labeled. Alternatively, more than one component is labeled with different labels, e.g., $I^{125}$ for the proteins and a fluorophor for the compound. Proximity reagents, e.g., quenching or energy transfer reagents are also useful.

XIII.N.) Competitive Binding to Identify and Characterize Modulators

In one embodiment, the binding of the "test compound" is determined by competitive binding assay with a "competitor." The competitor is a binding moiety that binds to the target molecule (e.g., a cancer protein of the invention). Competitors include compounds such as antibodies, peptides, binding partners, ligands, etc. Under certain circumstances, the competitive binding between the test compound and the competitor displaces the test compound. In one embodiment, the test compound is labeled. Either the test compound, the competitor, or both, is added to the protein for a time sufficient to allow binding. Incubations are performed at a temperature that facilitates optimal activity, typically between four and 40° C. Incubation periods are typically optimized, e.g., to facilitate rapid high throughput screening; typically between zero and one hour will be sufficient. Excess reagent is generally removed or washed away. The second component is then added, and the presence or absence of the labeled component is followed, to indicate binding.

In one embodiment, the competitor is added first, followed by the test compound. Displacement of the competitor is an indication that the test compound is binding to the cancer protein and thus is capable of binding to, and potentially modulating, the activity of the cancer protein. In this embodiment, either component can be labeled. Thus, e.g., if the competitor is labeled, the presence of label in the post-test compound wash solution indicates displacement by the test compound. Alternatively, if the test compound is labeled, the presence of the label on the support indicates displacement.

In an alternative embodiment, the test compound is added first, with incubation and washing, followed by the competitor. The absence of binding by the competitor indicates that the test compound binds to the cancer protein with higher affinity than the competitor. Thus, if the test compound is labeled, the presence of the label on the support, coupled with a lack of competitor binding, indicates that the test compound binds to and thus potentially modulates the cancer protein of the invention.

Accordingly, the competitive binding methods comprise differential screening to identity agents that are capable of modulating the activity of the cancer proteins of the invention. In this embodiment, the methods comprise combining a cancer protein and a competitor in a first sample. A second sample comprises a test compound, the cancer protein, and a competitor. The binding of the competitor is determined for both samples, and a change, or difference in binding between the two samples indicates the presence of an agent capable of binding to the cancer protein and potentially modulating its activity. That is, if the binding of the competitor is different in the second sample relative to the first sample, the agent is capable of binding to the cancer protein.

Alternatively, differential screening is used to identify drug candidates that bind to the native cancer protein, but cannot bind to modified cancer proteins. For example the structure of the cancer protein is modeled and used in rational drug design to synthesize agents that interact with that site, agents which generally do not bind to site-modified proteins. Moreover, such drug candidates that affect the activity of a native cancer protein are also identified by screening drugs for the ability to either enhance or reduce the activity of such proteins.

Positive controls and negative controls can be used in the assays. Preferably control and test samples are performed in at least triplicate to obtain statistically significant results.

Incubation of all samples occurs for a time sufficient to allow for the binding of the agent to the protein. Following incubation, samples are washed free of non-specifically bound material and the amount of bound, generally labeled agent determined. For example, where a radiolabel is employed, the samples can be counted in a scintillation counter to determine the amount of bound compound.

A variety of other reagents can be included in the screening assays. These include reagents like salts, neutral proteins, e.g. albumin, detergents, etc. which are used to facilitate optimal protein-protein binding and/or reduce non-specific or background interactions. Also reagents that otherwise improve the efficiency of the assay, such as protease inhibitors, nuclease inhibitors, anti-microbial agents, etc., can be used. The mixture of components is added in an order that provides for the requisite binding.

XIII.O.) Use of Polynucleotides to Down-Regulate or Inhibit a Protein of the Invention.

Polynucleotide modulators of cancer can be introduced into a cell containing the target nucleotide sequence by formation of a conjugate with a ligand-binding molecule, as described in WO 91/04753. Suitable ligand-binding molecules include, but are not limited to, cell surface receptors, growth factors, other cytokines, or other ligands that bind to cell surface receptors. Preferably, conjugation of the ligand binding molecule does not substantially interfere with the ability of the ligand binding molecule to bind to its corresponding molecule or receptor, or block entry of the sense or antisense oligonucleotide or its conjugated version into the cell. Alternatively, a polynucleotide modulator of cancer can be introduced into a cell containing the target nucleic acid sequence, e.g., by formation of a polynucleotide-lipid complex, as described in WO 90/10448. It is understood that the use of antisense molecules or knock out and knock in models may also be used in screening assays as discussed above, in addition to methods of treatment.

XIII.P.) Inhibitory and Antisense Nucleotides

In certain embodiments, the activity of a cancer-associated protein is down-regulated, or entirely inhibited, by the use of antisense polynucleotide or inhibitory small nuclear RNA (snRNA), i.e., a nucleic acid complementary to, and which can preferably hybridize specifically to, a coding mRNA nucleic acid sequence, e.g., a cancer protein of the invention, mRNA, or a subsequence thereof. Binding of the antisense polynucleotide to the mRNA reduces the translation and/or stability of the mRNA.

In the context of this invention, antisense polynucleotides can comprise naturally occurring nucleotides, or synthetic species formed from naturally occurring subunits or their close homologs. Antisense polynucleotides may also have altered sugar moieties or inter-sugar linkages. Exemplary among these are the phosphorothioate and other sulfur containing species which are known for use in the art. Analogs are comprised by this invention so long as they function effectively to hybridize with nucleotides of the invention. See, e.g., Isis Pharmaceuticals, Carlsbad, Calif.; Sequitor, Inc., Natick, Mass.

Such antisense polynucleotides can readily be synthesized using recombinant means, or can be synthesized in vitro. Equipment for such synthesis is sold by several vendors, including Applied Biosystems. The preparation of other oligonucleotides such as phosphorothioates and alkylated derivatives is also well known to those of skill in the art.

Antisense molecules as used herein include antisense or sense oligonucleotides. Sense oligonucleotides can, e.g., be employed to block transcription by binding to the anti-sense strand. The antisense and sense oligonucleotide comprise a single stranded nucleic acid sequence (either RNA or DNA) capable of binding to target mRNA (sense) or DNA (antisense) sequences for cancer molecules. Antisense or sense oligonucleotides, according to the present invention, comprise a fragment generally at least about 12 nucleotides, preferably from about 12 to 30 nucleotides. The ability to derive an antisense or a sense oligonucleotide, based upon a cDNA sequence encoding a given protein is described in, e.g., Stein &Cohen (Cancer Res. 48:2659 (1988 and van der Krol et al. (BioTechniques 6:958 (1988)).

XIII.Q.) Ribozymes

In addition to antisense polynucleotides, ribozymes can be used to target and inhibit transcription of cancer-associated nucleotide sequences. A ribozyme is an RNA molecule that catalytically cleaves other RNA molecules. Different kinds of ribozymes have been described, including group I ribozymes, hammerhead ribozymes, hairpin ribozymes, RNase P, and axhead ribozymes (see, e.g., Castanotto et al., Adv. in Pharmacology 25: 289-317 (1994) for a general review of the properties of different ribozymes).

The general features of hairpin ribozymes are described, e.g., in Hampel et al., Nucl. Acids Res. 18:299-304 (1990); European Patent Publication No. 0360257; U.S. Pat. No. 5,254,678. Methods of preparing are well known to those of skill in the art (see, e.g., WO 94/26877; Ojwang et al., Proc. Natl. Acad. Sci. USA 90:6340-6344 (1993); Yamada et al., Human Gene Therapy 1:39-45 (1994); Leavitt et al., Proc. Natl. Acad. Sci. USA 92:699-703 (1995); Leavitt et al., Human Gene Therapy 5: 1151-120 (1994); and Yamada et al., Virology 205: 121-126 (1994)).

XIII.R.) Use of Modulators in Phenotypic Screening

In one embodiment, a test compound is administered to a population of cancer cells, which have an associated cancer expression profile. By "administration" or "contacting" herein is meant that the modulator is added to the cells in such a manner as to allow the modulator to act upon the cell, whether by uptake and intracellular action, or by action at the cell surface. In some embodiments, a nucleic acid encoding a proteinaceous agent (i.e., a peptide) is put into a viral construct such as an adenoviral or retroviral construct, and added to the cell, such that expression of the peptide agent is accomplished, e.g., PCT US97/01019. Regulatable gene therapy systems can also be used. Once the modulator has been administered to the cells, the cells are washed if desired and are allowed to incubate under preferably physiological conditions for some period. The cells are then harvested and a new gene expression profile is generated. Thus, e.g., cancer tissue is screened for agents that modulate, e.g., induce or suppress, the cancer phenotype. A change in at least one gene, preferably many, of the expression profile indicates that the agent has an effect on cancer activity. Similarly, altering a biological function or a signaling pathway is indicative of modulator activity. By defining such a signature for the cancer phenotype, screens for new drugs that alter the phenotype are devised. With this approach, the drug target need not be known and need not be represented in the original gene/protein expression screening platform, nor does the level of transcript for the target protein need to change. The modulator inhibiting function will serve as a surrogate marker.

As outlined above, screens are done to assess genes or gene products. That is, having identified a particular differentially expressed gene as important in a particular state, screening of modulators of either the expression of the gene or the gene product itself is performed.

XIII.S.) Use of Modulators to Affect Peptides of the Invention

Measurements of cancer polypeptide activity, or of the cancer phenotype are performed using a variety of assays. For example, the effects of modulators upon the function of a cancer polypeptide(s) are measured by examining parameters described above. A physiological change that affects activity is used to assess the influence of a test compound on the polypeptides of this invention. When the functional outcomes are determined using intact cells or animals, a variety of effects can be assesses such as, in the case of a cancer associated with solid tumors, tumor growth, tumor metastasis, neovascularization, hormone release, transcriptional changes to both known and uncharacterized genetic markers (e.g., by Northern blots), changes in cell metabolism such as cell growth or pH changes, and changes in intracellular second messengers such as cGNIP.

XIII.T.) Methods of Identifying Characterizing Cancer-Associated Sequences

Expression of various gene sequences is correlated with cancer. Accordingly, disorders based on mutant or variant cancer genes are determined. In one embodiment, the invention provides methods for identifying cells containing variant cancer genes, e.g., determining the presence of, all or part, the sequence of at least one endogenous cancer gene in a cell. This is accomplished using any number of sequencing techniques. The invention comprises methods of identifying the cancer genotype of an individual, e.g., determining all or part of the sequence of at least one gene of the invention in the individual. This is generally done in at least one tissue of the individual, e.g., a tissue set forth in Table I, and may include the evaluation of a number of tissues or different samples of the same tissue. The method may include comparing the sequence of the sequenced gene to a known cancer gene, i.e., a wild-type gene to determine the presence of family members, homologies, mutations or variants. The sequence of all or part of the gene can then be compared to the sequence of a known cancer gene to determine if any differences exist. This is done using any number of known homology programs, such as BLAST, Bestfit, etc. The presence of a difference in the sequence between the cancer gene of the patient and the known cancer gene correlates with a disease state or a propensity for a disease state, as outlined herein.

In a preferred embodiment, the cancer genes are used as probes to determine the number of copies of the cancer gene in the genome. The cancer genes are used as probes to determine the chromosomal localization of the cancer genes. Information such as chromosomal localization finds use in providing a diagnosis or prognosis in particular when chromosomal abnormalities such as translocations, and the like are identified in the cancer gene locus.

XIV.) KITS/ARTICLES OF MANUFACTURE

For use in the laboratory, prognostic, prophylactic, diagnostic and therapeutic applications described herein, kits are within the scope of the invention. Such kits can comprise a carrier, package, or container that is compartmentalized to receive one or more containers such as vials, tubes, and the like, each of the container(s) comprising one of the separate elements to be used in the method, along with a label or insert comprising instructions for use, such as a use described herein. For example, the container(s) can comprise a probe that is or can be detectably labeled. Such probe can be an antibody or polynucleotide specific for a protein or a gene or message of the invention, respectively. Where the method utilizes nucleic acid hybridization to detect the target nucleic acid, the kit can also have containers containing nucleotide(s) for amplification of the target nucleic acid sequence. Kits can comprise a container comprising a reporter, such as a biotin-binding protein, such as avidin or streptavidin, bound to a reporter molecule, such as an enzymatic, fluorescent, or radioisotope label; such a reporter can be used with, e.g., a nucleic acid or antibody. The kit can include all or part of the amino acid sequences in FIG. 2 or FIG. 3 or analogs thereof, or a nucleic acid molecule that encodes such amino acid sequences.

The kit of the invention will typically comprise the container described above and one or more other containers associated therewith that comprise materials desirable from a commercial and user standpoint, including buffers, diluents, filters, needles, syringes; carrier, package, container, vial and/or tube labels listing contents and/or instructions for use, and package inserts with instructions for use.

A label can be present on or with the container to indicate that the composition is used for a specific therapy or non-therapeutic application, such as a prognostic, prophylactic, diagnostic or laboratory application, and can also indicate directions for either in vivo or in vitro use, such as those described herein. Directions and or other information can also be included on an insert(s) or label(s) which is included with or on the kit. The label can be on or associated with the container. A label can be on a container when letters, numbers or other characters forming the label are molded or etched into the container itself; a label can be associated with a container when it is present within a receptacle or carrier that also holds the container, e.g., as a package insert. The label can indicate that the composition is used for diagnosing, treating, prophylaxing or prognosing a condition, such as a neoplasia of a tissue set forth in Table I.

The terms "kit" and "article of manufacture" can be used as synonyms.

In another embodiment of the invention, an article(s) of manufacture containing compositions, such as amino acid sequence(s), small molecule(s), nucleic acid sequence(s), and/or antibody(s), e.g., materials useful for the diagnosis, prognosis, prophylaxis and/or treatment of neoplasias of tissues such as those set forth in Table I is provided. The article of manufacture typically comprises at least one container and at least one label. Suitable containers include, for example, bottles, vials, syringes, and test tubes. The containers can be formed from a variety of materials such as glass, metal or plastic. The container can hold amino acid sequence(s), small molecule(s), nucleic acid sequence(s), cell population(s) and/or antibody(s). In one embodiment, the container holds a polynucleotide for use in examining the mRNA expression profile of a cell, together with reagents used for this purpose. In another embodiment a container comprises an antibody, binding fragment thereof or specific binding protein for use in evaluating protein expression of 158P3D2 in cells and tissues, or for relevant laboratory, prognostic, diagnostic, prophylactic and therapeutic purposes; indications and/or directions for such uses can be included on or with such container, as can reagents and other compositions or tools used for these purposes. In another embodiment, a container comprises materials for eliciting a cellular or humoral immune response, together with associated indications and/or directions. In another embodiment, a container comprises materials for adoptive immunotherapy, such as cytotoxic T cells (CTL) or helper T cells (HTL), together with associated indications and/or directions; reagents and other compositions or tools used for such purpose can also be included.

The container can alternatively hold a composition that is effective for treating, diagnosis, prognosing or prophylaxing a condition and can have a sterile access port (for example the container can be an intravenous solution bag or a vial having a stopper pierceable by a hypodermic injection needle). The active agents in the composition can be an antibody capable of specifically binding 158P3D2 and modulating the function of 158P3D2.

The article of manufacture can further comprise a second container comprising a pharmaceutically-acceptable buffer, such as phosphate-buffered saline, Ringer's solution and/or dextrose solution. It can further include other materials desirable from a commercial and user standpoint, including other buffers, diluents, filters, stirrers, needles, syringes, and/or package inserts with indications and/or instructions for use.

EXAMPLES

Various aspects of the invention are further described and illustrated by way of the several examples that follow, none of which is intended to limit the scope of the invention.

Example 1

SSH-Generated Isolation of a cDNA Fragment of the 158P3D2 Gene

To isolate genes that are over-expressed in bladder cancer we used the Suppression Subtractive Hybridization (SSH) procedure using cDNA derived from bladder cancer tissues, including invasive transitional cell carcinoma. The 158P3D2 SSH cDNA sequence was derived from a bladder cancer pool minus normal bladder cDNA subtraction. Included in the driver were also cDNAs derived from 9 other normal tissues. The 158P3D2 cDNA was identified as highly expressed in the bladder cancer tissue pool, with lower expression seen in a restricted set of normal tissues.

The SSH DNA sequence of 312 bp (FIG. 1) shows identity to the fer-1-like 4 (*C. elegans*) (FER1L4) mRNA. A 158P3D2 cDNA clone 158P3D2-BCP1 of 1994 bp was isolated from bladder cancer cDNA, revealing an ORF of 328 amino acids (FIG. 2, FIG. 3).

Amino acid sequence analysis of 158P3D2 reveals 100% identity over 328 amino acid region to dJ477O4.1.1, a novel protein similar to otoferlin and dysferlin, isoform 1 protein (GenBank Accession CAB89410.1).

The 158P3D2 protein has a transmembrane domain of 23 residues between amino acids 292-313 predicted by the SOSUI Signal program.

Materials and Methods

Human Tissues:

The patient cancer and normal tissues were purchased from different sources such as the NDRI (Philadelphia, Pa.). mRNA for some of the normal tissues were purchased from Clontech, Palo Alto, Calif.

RNA Isolation:

Tissues were homogenized in Trizol reagent (Life Technologies, Gibco BRL) using 10 ml/g tissue isolate total RNA. Poly A RNA was purified from total RNA using Qiagen's Oligotex mRNA Mini and Midi kits. Total and mRNA were quantified by spectrophotometric analysis (O.D. 260/280 nm) and analyzed by gel electrophoresis.

Oligonucleotides:

The following HPLC purified oligonucleotides were used.

```
DPNCDN (cDNA synthesis primer):
                                          (SEQ ID NO: 67)
5'TTTTGATCAAGCTT₃₀3'

Adaptor 1:
                                          (SEQ ID NO: 68)
5'CTAATACGACTCACTATAGGGCTCGAGCGGCCGCCCGGGCAG3'

(SEQ ID NO: 69)
3'GGCCCGTCCTAG5'

Adaptor 2:
                                          (SEQ ID NO: 70)
5'GTAATACGACTCACTATAGGGCAGCGTGGTCGCGGCCGAG3'

(SEQ ID NO: 71)
3'CGGCTCCTAG5'

PCR primer 1:
                                          (SEQ ID NO: 72)
5'CTAATACGACTCACTATAGGGC3'

Nested primer (NP)1:
                                          (SEQ ID NO: 73)
5'TCGAGCGGCCGCCCGGGCAGGA3'

Nested primer (NP)2:
                                          (SEQ ID NO: 74)
5'AGCGTGGTCGCGGCCGAGGA3'
```

Suppression Subtractive Hybridization:

Suppression Subtractive Hybridization (SSH) was used to identify cDNAs corresponding to genes that may be differentially expressed in bladder cancer. The SSH reaction utilized cDNA from bladder cancer and normal tissues.

The gene 158P3D2 sequence was derived from a bladder cancer pool minus normal bladder cDNA subtraction. The SSH DNA sequence (FIG. 1) was identified.

The cDNA derived from of pool of normal bladder tissues was used as the source of the "driver" cDNA, while the cDNA from a pool of bladder cancer tissues was used as the source of the "tester" cDNA. Double stranded cDNAs corresponding to tester and driver cDNAs were synthesized from 2 μg of poly(A)⁺ RNA isolated from the relevant xenograft tissue, as described above, using CLONTECH's PCR-Select cDNA Subtraction Kit and 1 ng of oligonucleotide DPNCDN as primer. First- and second-strand synthesis were carried out as described in the Kit's user manual protocol (CLONTECH Protocol No. PT1117-1, Catalog No. K1804-1). The resulting cDNA was digested with Dpn II for 3 hrs at 37° C. Digested cDNA was extracted with phenol/chloroform (1:1) and ethanol precipitated.

Driver cDNA was generated by combining in a 1:1 ratio Dpn II digested cDNA from the relevant tissue source (see above) with a mix of digested cDNAs derived from the nine normal tissues: stomach, skeletal muscle, lung, brain, liver, kidney, pancreas, small intestine, and heart.

Tester cDNA was generated by diluting 1 μl of Dpn II digested cDNA from the relevant tissue source (see above) (400 ng) in 5 μl of water. The diluted cDNA (2 μl, 160 ng) was then ligated to 2 μl of Adaptor 1 and Adaptor 2 (10 μM), in separate ligation reactions, in a total volume of 10 μl at 16° C. overnight, using 400 u of T4 DNA ligase (CLONTECH). Ligation was terminated with 1 μl of 0.2 M EDTA and heating at 72° C. for 5 min.

The first hybridization was performed by adding 1.5 μl (600 ng) of driver cDNA to each of two tubes containing 1.5 μl (20 ng) Adaptor 1- and Adaptor 2-ligated tester cDNA. In a final volume of 4 μl, the samples were overlaid with mineral oil, denatured in an MJ Research thermal cycler at 98° C. for 1.5 minutes, and then were allowed to hybridize for 8 hrs at 68° C. The two hybridizations were then mixed together with an additional 1 μl of fresh denatured driver cDNA and were allowed to hybridize overnight at 68° C. The second hybridization was then diluted in 200 μl of 20 mM Hepes, pH 8.3, 50 mM NaCl, 0.2 mM EDTA, heated at 70° C. for 7 min. and stored at −20° C.

PCR Amplification, Cloning and Sequencing of Gene Fragments Generated from SSH:

To amplify gene fragments resulting from SSH reactions, two PCR amplifications were performed. In the primary PCR reaction 1 µl of the diluted final hybridization mix was added to 1 µl of PCR primer 1 (10 µM), 0.5 µl dNTP mix (10 µM), 2.5 µl 10× reaction buffer (CLONTECH) and 0.5 µl 50× Advantage cDNA polymerase Mix (CLONTECH) in a final volume of 25 µl. PCR 1 was conducted using the following conditions: 75° C. for 5 min., 94° C. for 25 sec., then 27 cycles of 94° C. for 10 sec, 66° C. for 30 sec, 72° C. for 1.5 min. Five separate primary PCR reactions were performed for each experiment. The products were pooled and diluted 1:10 with water. For the secondary PCR reaction, 1 µl from the pooled and diluted primary PCR reaction was added to the same reaction mix as used for PCR 1, except that primers NP1 and NP2 (10 µM) were used instead of PCR primer 1. PCR 2 was performed using 10-12 cycles of 94° C. for 10 sec, 68° C. for 30 sec, and 72° C. for 1.5 minutes. The PCR products were analyzed using 2% agarose gel electrophoresis.

The PCR products were inserted into pCR2.1 using the T/A vector cloning kit (Invitrogen). Transformed *E. coli* were subjected to blue/white and ampicillin selection. White colonies were picked and arrayed into 96 well plates and were grown in liquid culture overnight. To identify inserts, PCR amplification was performed on 1 ml of bacterial culture using the conditions of PCR1 and NP1 and NP2 as primers. PCR products were analyzed using 2% agarose gel electrophoresis.

Bacterial clones were stored in 20% glycerol in a 96 well format. Plasmid DNA was prepared, sequenced, and subjected to nucleic acid homology searches of the GenBank, dBest, and NCI-CGAP databases.

RT-PCR Expression Analysis:

First strand cDNAs can be generated from 1 µg of mRNA with oligo (dT) 12-18 priming using the Gibco-BRL Superscript Preamplification system. The manufacturer's protocol was used which included an incubation for 50 min at 42° C. with reverse transcriptase followed by RNAse H treatment at 37° C. for 20 min. After completing the reaction, the volume can be increased to 200 µl with water prior to normalization. First strand cDNAs from 16 different normal human tissues can be obtained from Clontech.

Normalization of the first strand cDNAs from multiple tissues was performed by using the primers 5'atatcgc-cgcgctcgtcgtcgacaa3' (SEQ ID NO: 75) and 5'agccacacg-cagctcattgtagaagg 3' (SEQ ID NO: 76) to amplify β-actin. First strand cDNA (5 µl) were amplified in a total volume of 50 µl containing 0.4 µM primers, 0.2 µM each dNTPs, 1×PCR buffer (Clontech, 10 mM Tris-HCL, 1.5 mM MgCl$_2$, 50 mM KCl, pH8.3) and 1× Klentaq DNA polymerase (Clontech). Five µl of the PCR reaction can be removed at 18, 20, and 22 cycles and used for agarose gel electrophoresis. PCR was performed using an MJ Research thermal cycler under the following conditions: Initial denaturation can be at 94° C. for 15 sec, followed by a 18, 20, and 22 cycles of 94° C. for 15, 65° C. for 2 min, 72° C. for 5 sec. A final extension at 72° C. was carried out for 2 min. After agarose gel electrophoresis, the band intensities of the 283 b.p. β-actin bands from multiple tissues were compared by visual inspection. Dilution factors for the first strand cDNAs were calculated to result in equal β-actin band intensities in all tissues after 22 cycles of PCR. Three rounds of normalization can be required to achieve equal band intensities in all tissues after 22 cycles of PCR.

To determine expression levels of the 158P3D2 gene, 5 µl of normalized first strand cDNA were analyzed by PCR using 26, and 30 cycles of amplification. Semi-quantitative expression analysis can be achieved by comparing the PCR products at cycle numbers that give light band intensities. The primers used for RT-PCR were designed using the 158P3D2 SSH sequence and are listed below:

```
158P3D2.1
5' CATCTATGTGAAGAGCTGGGTGAA 3'  (SEQ ID NO: 77)

158P3D2.2
5' AGGTAGTCAAAGCGGAACACAAAG 3'  (SEQ ID NO: 78)
```

Additional primers were also designed to test for expression of the different splice variants and these are listed below:

| Primer Name | Sequence |
|---|---|
| 158P3D2 ex. 17-R | GTCCTCCCAGCAACTCCACACA (SEQ ID NO: 79) |
| 158P3D2 ex. 26-F | TGTCCCTTCCACCCAACGTGTGC (SEQ ID NO: 80) |
| 158P3D2 ex. 28-R | TCCTCCATCTCTCCTTCCTCCTCAG (SEQ ID NO: 81) |
| 158P3D2 ex. 9-F | CAGAAACTGGTGGGAGTCAACA (SEQ ID NO: 82) |
| 158P3D2 ex.1-F | ATGGCTCTGACGGTAAGCGTGC (SEQ ID NO: 83) |
| 158P3D2 ex.10-F | ATAGGCACCTTCAGGATGGACC (SEQ ID NO: 84) |
| 158P3D2 ex.10-R | TCCATCCTGAAGGTGCCTATCC (SEQ ID NO: 85) |
| 158P3D2 ex.16-F | CAGAGGAGGAGAAAGAGGAGG (SEQ ID NO: 86) |
| 158P3D2 ex.16-R | TCCTCTTTCTCCTCCTCTGG (SEQ ID NO: 87) |
| 158P3D2 ex.21-F | AGATCCAGAGTCTAATGCTCACG (SEQ ID NO: 88) |
| 158P3D2 ex.21-R | CGTGAGCATTAGACTCTGGATC (SEQ ID NO: 89) |
| 158P3D2 ex.27-F | AAGGTGTGGAGTCTGAGGTC (SEQ ID NO: 90) |
| 158P3D2 ex.27-R | ACCTCAGACTCCACACCTTGC (SEQ ID NO: 91) |
| 158P3D2 ex.34-R | ACTCTGACCAGGAGCTTGATG (SEQ ID NO: 92) |
| 158P3D2 ex.40-F | ACACGGAGGATGTGGTTCTGG (SEQ ID NO: 93) |
| 158P3D2 ex.43-F | TTGAGCTGCTGACTGTGGAGGAG (SEQ ID NO: 94) |
| 158P3D2 ex.43-R | TCCTCCACAGTCAGCAGCTC (SEQ ID NO: 95) |
| 158P3D2 ex.44-R | TGAGTGTCCAAGGTCAGCGAG (SEQ ID NO: 96) |
| 158P3D2 ex.7-F | AGAGAATGAGCTGGAGCTTGAGC (SEQ ID NO: 97) |
| 158P3D2 ex.7-R | TCAAGCTCCAGCTCATTCTCTTC (SEQ ID NO: 98) |

| Primer Name | Sequence |
|---|---|
| AGS-25 long RT PCR-3' | TAACACCAGAAAGTTCCACGTCAG (SEQ ID NO: 99) |
| AGS-25 long RT PCR-5' | TGACGGTCGCCGTATTTGATC (SEQ ID NO: 100) |
| AGS-25 short RT PCR-3' | GATTGGCTGCCGAGGCTTGA (SEQ ID NO: 101) |
| AGS-25 short RT PCR-5' | TGACGGTCGCCGTATTTGATC (SEQ ID NO: 102) |

A typical RT-PCR expression analysis is shown in FIG. 14. RT-PCR expression analysis was performed on first strand cDNAs generated using pools of tissues from multiple samples. The cDNAs were shown to be normalized using beta-actin PCR. Results show strong expression of 158P3D2 in bladder cancer pool, kidney cancer pool and cancer metastasis pool. Expression of 158P3D2 is also detected in colon cancer pool, lung cancer pool, ovary cancer pool, breast cancer pool, pancreas cancer pool and prostate metastases to lymph node, and vital pool 2, but not vital pool 1.

Example 2

Full Length Cloning of 158P3D2

The 158P3D2 SSH cDNA sequence was derived from a bladder cancer pool minus normal bladder cDNA subtraction. The SSH cDNA sequence (FIG. 1) was designated 158P3D2. The full-length cDNA clone 158P3D2 v.1 clone 158P3D2-BCP1 and 158P3D2-BCP2 (FIG. 2) were cloned from bladder cancer pool cDNA.

Additional 158P3D2 splice and SNP variants have been identified and these are listed in FIG. 2 and FIG. 3.

Example 3

Chromosomal Mapping of 158P3D2

Chromosomal localization can implicate genes in disease pathogenesis. Several chromosome mapping approaches are available including fluorescent in situ hybridization (FISH), human/hamster radiation hybrid (RH) panels (Walter et al., 1994; Nature Genetics 7:22; Research Genetics, Huntsville Ala.), human-rodent somatic cell hybrid panels such as is available from the Coriell Institute (Camden, N.J.), and genomic viewers utilizing BLAST homologies to sequenced and mapped genomic clones (NCBI, Bethesda, Md.).

158P3D2 maps to chromosome 8, using 158P3D2 sequence and the NCBI BLAST tool located on the World Wide Web at: (ncbi.nlm.nih.gov/genome/seq/page.cgi?F=HsBlast.html&&ORG=Hs).

Example 4

Expression Analysis of 158P3D2 in Normal Tissues and Patient Specimens

Expression analysis by RT-PCR demonstrated that 158P3D2 is strongly expressed in multiple cancer patient specimens, but unrestricted normal tissues (FIG. 14). First strand cDNA was prepared from a panel of 13 normal tissues (brain, heart, kidney, liver, lung, spleen, skeletal muscle, testis, pancreas, colon, stomach) and pools of 4-7 patients from the following cancer indications: bladder, kidney, colon, lung, pancreas, stomach, ovary, breast, multiple cancer metastasis, cervix, lymphoma as well as from a pool of patient-derived xenografts (prostate cancer, bladder cancer and kidney cancer). Normalization was performed by PCR using primers to actin and GAPDH. Semi-quantitative PCR, using primers to 158P3D2, was performed at 26 and 30 cycles of amplification. Samples were run on an agarose gel, and PCR products were quantitated using the AlphaImager software. Results show strong expression of 158P3D2 in cancers of the bladder, kidney, colon, lung, pancreas, stomach, ovary, breast, cervix, and lymphoma. Strong expression was also observed in the cancer metastasis pool. Low expression was detected in all normal tissues tested except in normal stomach.

Expression of 158P3D2 in bladder cancer patient specimens and human normal tissues is shown in FIG. 15. First strand cDNA was prepared from normal bladder, bladder cancer cell lines (UM-UC-3, TCCSUP, J82) and a panel of bladder cancer patient specimens. Normalization was performed by PCR using primers to actin and GAPDH. Expression level was recorded as no expression (no signal detected), low (signal detected at 30×), medium (signal detected at 26×), high (strong signal at 26×). Results show expression of 158P3D2 in the majority of bladder cancer patient specimens tested. Very low expression was detected in normal tissues, but no expression was seen in the cell lines tested.

Northern blot analysis of 158P3D2 in bladder specimens is shown in FIG. 16. RNA was extracted from normal bladder, bladder cancer cell lines (UM-UC-3, J82, SCaBER), bladder cancer patient tumors (T) and their normal adjacent tissues (NAT). Northern blot with 10 µg of total RNA were probed with the 158P3D2 sequence. Size standards in kilobases are on the side. Results show strong expression of 158P3D2 in tumor tissues, but not in normal, nor NAT tissues.

FIG. 17 shows 158P3D2 expression in lung cancer patient specimens. First strand cDNA was prepared from normal lung, cancer cell line A427 and a panel of lung cancer patient specimens. Normalization was performed by PCR using primers to actin and GAPDH. Semi-quantitative PCR, using primers to 158P3D2, was performed at 26 and 30 cycles of amplification. Expression level was recorded as no expression (no signal detected), low (signal detected at 30×), medium (signal detected at 26×), high (strong signal at 26×). 158P3D2 is expressed at varying levels in $^{35}/_{39}$ (90%) of lung cancer specimens, but not in all 3 normal lung tissues tested.

Northern blot analysis of 158P3D2 expression in lung cancer patient specimens is shown in FIG. 18. RNA was extracted from normal lung, A427 lung cancer cell line, and a panel of lung cancer patient specimens. Northern blot with 10 µg of total RNA were probed with the 158P3D2 sequence. Size standards in kilobases are on the side. Results show strong expression of 158P3D2 in tumor specimens but not in normal tissues.

FIG. 19 shows 158P3D2 expression in cancer metastasis patient specimens. First strand cDNA was prepared from normal colon, kidney, liver, lung, pancreas, stomach and from a panel of cancer metastasis patient specimens. Normalization was performed by PCR using primers to actin and GAPDH. Semi-quantitative PCR, using primers to 158P3D2, was performed at 26 and 30 cycles of amplification. Expression level was recorded as no expression (no signal detected), low (signal detected at 30×), medium (signal detected at 26×), high (strong signal at 26×). Results show expression of 158P3D2 in the majority of patient cancer metastasis specimens tested but not in normal tissues.

FIG. 20 shows 158P3D2 expression in cervical cancer patient specimens. First strand cDNA was prepared from normal cervix, cervical cancer cell line HeLa, and a panel of cervical cancer patient specimens. Normalization was performed by PCR using primers to actin and GAPDH. Expression level was recorded as no expression (no signal detected), low (signal detected at 30x), medium (signal detected at 26x), high (strong signal at 26x). Results show expression of 158P3D2 in all 14 cervical cancer patient specimens tested. No expression was detected in normal cervix or in the cell line tested.

Northern blot analysis of 158P3D2 expression in cervical cancer patient specimens is shown in FIG. 21. RNA was extracted from normal cervix, cervical cancer cell line HeLa, and a panel of cervical cancer patient specimens. Northern blot with 10 μg of total RNA were probed with the 158P3D2 sequence. Size standards in kilobases are on the side. Results show strong expression of 158P3D2 in tumor tissues, but not in normal cervix nor in the cell line.

FIG. 22 shows 158P3D2 expression in kidney cancer patient specimens. First strand cDNA was prepared from normal kidney, kidney cancer cell lines (769-P, A-498, CAKI-1), and a panel of kidney cancer patient specimens. Normalization was performed by PCR using primers to actin and GAPDH. Semi-quantitative PCR, using primers to 158P3D2, was performed at 26 and 30 cycles of amplification. Expression level was recorded as no expression (no signal detected), low (signal detected at 30x), medium (signal detected at 26x), high (strong signal at 26x). 158P3D2 is expressed at varying levels in the majority of kidney cancer patient specimens, but not in all 3 normal kidney tissues tested. Low expression was detected in 2 of 3 cell lines tested.

FIG. 23 shows 158P3D2 expression in kidney cancer patient specimens by northern blotting. RNA was extracted from normal kidney and a panel of kidney cancer patient specimens. Northern blot with 10 μg of total RNA were probed with the 158P3D2 sequence. Size standards in kilobases are on the side. Results show strong expression of 158P3D2 in tumor specimens but not in the normal tissue.

FIG. 24 shows 158P3D2 expression in stomach cancer patient specimens. First strand cDNA was prepared from normal stomach, and a panel of stomach cancer patient specimens. Normalization was performed by PCR using primers to actin and GAPDH. Semi-quantitative PCR, using primers to 158P3D2, was performed at 26 and 30 cycles of amplification. Expression level was recorded as no expression (no signal detected), low (signal detected at 30x), medium (signal detected at 26x), high (strong signal at 26x). 158P3D2 is expressed at varying levels in the majority of stomach cancer patient specimens. Weak expression was detected in the 2 normal stomach, and only in 1 of the 2 NAT tissues tested.

FIG. 25 shows 158P3D2 expression in stomach cancer patient specimens by northern blotting. RNA was extracted from normal stomach and a panel of stomach cancer patient specimens. Northern blot with 10 μg of total RNA were probed with the 158P3D2 sequence. Size standards in kilobases are on the side. Results show strong expression of 158P3D2 in tumor specimens but not in the normal tissue.

FIG. 26 shows 158P3D2 expression in colon cancer patient specimens. First strand cDNA was prepared from normal colon, colon cancer cell lines (LoVo, CaCO-2, SK CO 1, Colo 205, T284), and a panel of colon cancer patient specimens. Normalization was performed by PCR using primers to actin and GAPDH. Semi-quantitative PCR, using primers to 158P3D2, was performed at 26 and 30 cycles of amplification. Expression level was recorded as no expression (no signal detected), low (signal detected at 30xs), medium (signal detected at 26x), high (strong signal at 26x). 158P3D2 is expressed at varying levels in the majority of colon cancer patient specimens. But it was weakly expressed in just 2 of 3 normal tissues, and 3 of 5 cell lines tested.

FIG. 27 shows 158P3D2 expression in uterus cancer patient specimens. First strand cDNA was prepared from normal uterus and a panel of uterus cancer patient specimens. Normalization was performed by PCR using primers to actin and GAPDH. Semi-quantitative PCR, using primers to 158P3D2, was performed at 26 and 30 cycles of amplification. Expression level was recorded as no expression (no signal detected), low (signal detected at 30x), medium (signal detected at 26x), high (strong signal at 26x). Results show 158P3D2 is expressed at varying levels in the majority of uterus cancer patient specimens, but not in normal uterus.

FIG. 28 shows 158P3D2 expression in breast cancer patient specimens. First strand cDNA was prepared from normal breast, breast cancer cell lines (MD-MBA-435S, DU4475, MCF-7, CAMA-1, MCF10A), and a panel of breast cancer patient specimens. Normalization was performed by PCR using primers to actin and GAPDH. Semi-quantitative PCR, using primers to 158P3D2, was performed at 26 and 30 cycles of amplification. Expression level was recorded as no expression (no signal detected), low (signal detected at 30x), medium (signal detected at 26x), high (strong signal at 26x). Results show 158P3D2 is expressed at varying levels in the majority of breast cancer patient specimens. But it was weakly expressed in just 2 of 3 normal tissues, and 2 of 5 cell lines tested.

The restricted expression of 158P3D2 in normal tissues and the expression detected in bladder cancer, kidney cancer, colon cancer, lung cancer, pancreas cancer, stomach cancer, ovary cancer, breast cancer, uterus cancer, cervical cancer and lymphoma suggest that 158P3D2 is a potential therapeutic target and a diagnostic marker for the treatment of human cancers.

Example 5

Transcript Variants of 158P3D2

Transcript variants are variants of mature mRNA from the same gene which arise by alternative transcription or alternative splicing. Alternative transcripts are transcripts from the same gene but start transcription at different points. Splice variants are mRNA variants spliced differently from the same transcript. In eukaryotes, when a multi-exon gene is transcribed from genomic DNA, the initial RNA is spliced to produce functional mRNA, which has only exons and is used for translation into an amino acid sequence. Accordingly, a given gene can have zero to many alternative transcripts and each transcript can have zero to many splice variants. Each transcript variant has a unique exon makeup, and can have different coding and/or non-coding (5' or 3' end) portions, from the original transcript. Transcript variants can code for similar or different proteins with the same or a similar function or can encode proteins with different functions, and can be expressed in the same tissue at the same time, or in different tissues at the same time, or in the same tissue at different times, or in different tissues at different times. Proteins encoded by transcript variants can have similar or different cellular or extracellular localizations, e.g., secreted versus intracellular.

Transcript variants are identified by a variety of art-accepted methods. For example, alternative transcripts and splice variants are identified by full-length cloning experiment, or by use of full-length transcript and EST sequences.

First, all human ESTs were grouped into clusters which show direct or indirect identity with each other. Second, ESTs in the same cluster were further grouped into sub-clusters and assembled into a consensus sequence. The original gene sequence is compared to the consensus sequence(s) or other full-length sequences. Each consensus sequence is a potential splice variant for that gene. Even when a variant is identified that is not a full-length clone, that portion of the variant is very useful for antigen generation and for further cloning of the full-length splice variant, using techniques known in the art.

Moreover, computer programs are available in the art that identify transcript variants based on genomic sequences. Genomic-based transcript variant identification programs include FgenesH (A. Salamov and V. Solovyev, "Ab initio gene finding in *Drosophila* genomic DNA," Genome Research. 2000 April; 10(4):516-22); Grail (URL comp-bio.oml.gov/Grail-bin/EmptyGrailForm) and GenScan (URL genes.mit.edu/GENSCAN.html). For a general discussion of splice variant identification protocols see., e.g., Southan, C., A genomic perspective on human proteases, FEBS Lett. 2001 Jun. 8; 498(2-3):214-8; de Souza, S. J., et al., Identification of human chromosome 22 transcribed sequences with ORF expressed sequence tags, Proc. Natl. Acad Sci USA. 2000 Nov. 7; 97(23):12690-3.

To further confirm the parameters of a transcript variant, a variety of techniques are available in the art, such as full-length cloning, proteomic validation, PCR-based validation, and 5' RACE validation, etc. (see e.g., Proteomic Validation: Brennan, S. O., et al., Albumin banks peninsula: a new termination variant characterized by electrospray mass spectrometry, Biochem Biophys Acta. 1999 Aug. 17; 1433(1-2): 321-6; Ferranti P, et al., Differential splicing of pre-messenger RNA produces multiple forms of mature caprine alpha(s1)-casein, Eur J. Biochem. 1997 Oct. 1; 249(1):1-7. For PCR-based Validation: Wellmann S, et al., Specific reverse transcription-PCR quantification of vascular endothelial growth factor (VEGF) splice variants by LightCycler technology, Clin Chem. 2001 April; 47(4):654-60; Jia, H. P., et al., Discovery of new human beta-defensins using a genomics-based approach, Gene. 2001 Jan. 24; 263(1-2): 211-8. For PCR-based and 5' RACE Validation: Brigle, K. E., et al., Organization of the murine reduced folate carrier gene and identification of variant splice forms, Biochem Biophys Acta. 1997 Aug. 7; 1353(2): 191-8).

It is known in the art that genomic regions are modulated in cancers. When the genomic region to which a gene maps is modulated in a particular cancer, the alternative transcripts or splice variants of the gene are modulated as well. Disclosed herein is that 158P3D2 has a particular expression profile related to cancer. Alternative transcripts and splice variants of 158P3D2 may also be involved in cancers in the same or different tissues, thus serving as tumor-associated markers/antigens.

Using the full-length gene and EST sequences, six transcript variants were identified, designated as 158P3D2 v.2, v.14 through v.18. The boundaries of the exon in the original transcript, 158P3D2 v.1 were shown in Table LI. Exon compositions of the variants are shown in FIG. 10. Each different combination of exons in spatial order, e.g. exon 1 of v.2 and exons 3, 4, 5 and 6 of v.1, is a potential splice variant.

Tables LII(a)-(f) through LV(a)-(f) are set forth on a variant-by-variant bases. Tables LII(a)-(f) show nucleotide sequence of the transcript variants. Tables LIII(a)-(f) show the alignment of the respective transcript variant with nucleic acid sequence of 158P3D2 v.1. Tables LIV(a)-(f) lay out amino acid translation of the transcript variants for the identified reading frame orientation. Tables LV(a)-(f) displays alignments of the amino acid sequence encoded by the splice variant with that of 158P3D2 v.1.

Example 6

Single Nucleotide Polymorphisms of 158P3D2

A Single Nucleotide Polymorphism (SNP) is a single base pair variation in a nucleotide sequence at a specific location. At any given point of the genome, there are four possible nucleotide base pairs: A/T, C/G, G/C and T/A. Genotype refers to the specific base pair sequence of one or more locations in the genome of an individual. Haplotype refers to the base pair sequence of more than one location on the same DNA molecule (or the same chromosome in higher organisms), often in the context of one gene or in the context of several tightly linked genes. SNP that occurs on a cDNA is called cSNP. This cSNP may change amino acids of the protein encoded by the gene and thus change the functions of the protein. Some SNP cause inherited diseases; others contribute to quantitative variations in phenotype and reactions to environmental factors including diet and drugs among individuals. Therefore, SNP and/or combinations of alleles (called haplotypes) have many applications, including diagnosis of inherited diseases, determination of drug reactions and dosage, identification of genes responsible for diseases, and analysis of the genetic relationship between individuals (P. Nowotny, J. M. Kwon and A. M. Goate, "SNP analysis to dissect human traits," Curr. Opin. Neurobiol. 2001 October; 11(5):637-641; M. Pirmohamed and B. K. Park, "Genetic susceptibility to adverse drug reactions," Trends Pharmacol. Sci. 2001 June; 22(6):298-305; J. H. Riley, C. J. Allan, E. Lai and A. Roses, "The use of single nucleotide polymorphisms in the isolation of common disease genes," Pharmacogenomics. 2000 February; 1(1):39-47; R. Judson, J. C. Stephens and A. Windemuth, "The predictive power of haplotypes in clinical response," Pharmacogenomics. 2000 February; 1(1):15-26).

SNP are identified by a variety of art-accepted methods (P. Bean, "The promising voyage of SNP target discovery," Am. Clin. Lab. 2001 October-November; 20(9): 18-20; K. M. Weiss, "In search of human variation," Genome Res. 1998 July; 8(7):691-697; M. M. She, "Enabling large-scale pharmacogenetic studies by high-throughput mutation detection and genotyping technologies," Clin. Chem. 2001 February; 47(2): 164-172). For example, SNP can be identified by sequencing DNA fragments that show polymorphism by gel-based methods such as restriction fragment length polymorphism (RFLP) and denaturing gradient gel electrophoresis (DGGE). They can also be discovered by direct sequencing of DNA samples pooled from different individuals or by comparing sequences from different DNA samples. With the rapid accumulation of sequence data in public and private databases, one can discover SNP by comparing sequences using computer programs (Z. Gu, L. Hillier and P. Y. Kwok, "Single nucleotide polymorphism hunting in cyberspace," Hum. Mutat. 1998; 12(4):221-225). SNP can be verified and genotype or haplotype of an individual can be determined by a variety of methods including direct sequencing and high throughput microarrays (P. Y. Kwok, "Methods for genotyping single nucleotide polymorphisms," Annu. Rev. Genomics Hum. Genet. 2001; 2:235-258; M. Kokoris, K. Dix, K. Moynihan, J. Mathis, B. Erwin, P. Grass, B. Hines and A. Duesterhoeft, "High-throughput SNP genotyping with the Masscode system," Mol. Diagn. 2000 December; 5(4):329-340).

Using the methods described above, twelve SNP were identified in the original transcript, 158P3D2 v.1, at positions 1155 (T/C), 1152 (G/A), 960 (G/T) and 1236 (G/-), 519 (A/G), 440 (T/A), 971 (T/C), 150 (C/G), 1022 (C/A), 1148 (G/A), 1691 (G/T) and 1692 (A/G). The transcripts or proteins with alternative allele were designated as variant 158P3D2 v.3 through v.13, respectively. FIG. 12 shows the schematic alignment of the SNP variants. FIG. 11 shows the schematic alignment of protein variants, corresponding to nucleotide variants. Nucleotide variants that code for the same amino acid sequence as v.1 are not shown in FIG. 11. These alleles of the SNP, though shown separately here, can occur in different combinations (haplotypes) and in any one of the transcript variants (such as 158P3D2 v.17) that contains the site of the SNP.

Example 7

Production of Recombinant 158P3D2 in Prokaryotic Systems

To express recombinant 158P3D2 and 158P3D2 variants in prokaryotic cells, the full or partial length 158P3D2 and 158P3D2 variant cDNA sequences are cloned into any one of a variety of expression vectors known in the art. One or more of the following regions of 158P3D2 variants are expressed: the full length sequence presented in FIGS. 2 and 3, or any 8, 9, 10, 11, 12, 13, 14, 15, 16, 17, 18, 19, 20, 21, 22, 23, 24, 25, 26, 27, 28, 29, 30 or more contiguous amino acids from 158P3D2, variants, or analogs thereof.

A. In Vitro Transcription and Translation Constructs pCRII: To generate 158P3D2 sense and anti-sense RNA probes for RNA in situ investigations, pCRII constructs (Invitrogen, Carlsbad Calif.) are generated encoding either all or fragments of the 158P3D2 cDNA. The pCRII vector has Sp6 and T7 promoters flanking the insert to drive the transcription of 158P3D2 RNA for use as probes in RNA in situ hybridization experiments. These probes are used to analyze the cell and tissue expression of 158P3D2 at the RNA level. Transcribed 158P3D2 RNA representing the cDNA amino acid coding region of the 158P3D2 gene is used during in vitro translation systems such as the TnT™ Coupled Reticulolysate System (Promega, Corp., Madison, Wis.) to synthesize 158P3D2 protein.

B. Bacterial Constructs pGEX Constructs: To generate recombinant 158P3D2 proteins in bacteria that are fused to the Glutathione S-transferase (GST) protein, all or parts of the 158P3D2 cDNA protein coding sequence are cloned into the pGEX family of GST-fusion vectors (Amersham Pharmacia Biotech, Piscataway, N.J.). These constructs allow controlled expression of recombinant 158P3D2 protein sequences with GST fused at the amino-terminus and a six histidine epitope (6× His) at the carboxyl-terminus. The GST and 6× His tags permit purification of the recombinant fusion protein from induced bacteria with the appropriate affinity matrix and allow recognition of the fusion protein with anti-GST and anti-His antibodies. The 6× His tag is generated by adding 6 histidine codons to the cloning primer at the 3' end, e.g., of the open reading frame (ORF). A proteolytic cleavage site, such as the PreScission™ recognition site in pGEX-6P-1, may be employed such that it permits cleavage of the GST tag from 158P3D2-related protein. The ampicillin resistance gene and pBR322 origin permits selection and maintenance of the pGEX plasmids in E. coli.

pMAL Constructs: To generate, in bacteria, recombinant 158P3D2 proteins that are fused to maltose-binding protein (MBP), all or parts of the 158P3D2 cDNA protein coding sequence are fused to the MBP gene by cloning into the pMAL-c2X and pMAL-p2X vectors (New England Biolabs, Beverly, Mass.). These constructs allow controlled expression of recombinant 158P3D2 protein sequences with MBP fused at the amino-terminus and a 6× His epitope tag at the carboxyl-terminus. The MBP and 6× His tags permit purification of the recombinant protein from induced bacteria with the appropriate affinity matrix and allow recognition of the fusion protein with anti-MBP and anti-His antibodies. The 6× His epitope tag is generated by adding 6 histidine codons to the 3' cloning primer. A Factor Xa recognition site permits cleavage of the pMAL tag from 158P3D2. The pMAL-c2X and pMAL-p2X vectors are optimized to express the recombinant protein in the cytoplasm or periplasm respectively. Periplasm expression enhances folding of proteins with disulfide bonds.

pET Constructs: To express 158P3D2 in bacterial cells, all or parts of the 158P3D2 cDNA protein coding sequence are cloned into the pET family of vectors (Novagen, Madison, Wis.). These vectors allow tightly controlled expression of recombinant 158P3D2 protein in bacteria with and without fusion to proteins that enhance solubility, such as NusA and thioredoxin (Trx), and epitope tags, such as 6× His and S-Tag™ that aid purification and detection of the recombinant protein. For example, constructs are made utilizing pET NusA fusion system 43.1 such that regions of the 158P3D2 protein are expressed as amino-terminal fusions to NusA. The cDNA encoding amino acids 155-290 and amino acids 260-328 of 158P3D2 each were cloned into the pET-21b vector. The recombinant proteins can be used to generate rabbit polyclonal antibodies.

C. Yeast Constructs:

pESC Constructs: To express 158P3D2 in the yeast species *Saccharomyces cerevisiae* for generation of recombinant protein and functional studies, all or parts of the 158P3D2 cDNA protein coding sequence are cloned into the pESC family of vectors each of which contain 1 of 4 selectable markers, HIS3, TRP1, LEU2, and URA3 (Stratagene, La Jolla, Calif.). These vectors allow controlled expression from the same plasmid of up to 2 different genes or cloned sequences containing either Flag™ or Myc epitope tags in the same yeast cell. This system is useful to confirm protein-protein interactions of 158P3D2. In addition, expression in yeast yields similar post-translational modifications, such as glycosylations and phosphorylations, that are found when expressed in eukaryotic cells.

pESP Constructs: To express 158P3D2 in the yeast species *Saccharomyces pombe*, all or parts of the 158P3D2 cDNA protein coding sequence are cloned into the pESP family of vectors. These vectors allow controlled high level of expression of a 158P3D2 protein sequence that is fused at either the amino terminus or at the carboxyl terminus to GST which aids purification of the recombinant protein. A Flag™ epitope tag allows detection of the recombinant protein with anti-Flag™ antibody.

Example 8

Production of Recombinant 158P3D2 in Higher Eukaryotic Systems

A. Mammalian Constructs:

To express recombinant 158P3D2 in eukaryotic cells, the full or partial length 158P3D2 cDNA sequences, or variants thereof, can be cloned into any one of a variety of expression vectors known in the art. One or more of the following regions of 158P3D2 are expressed in these constructs, amino acids 1 to 328, or any 8, 9, 10, 11, 12, 13, 14, 15, 16, 17, 18, 19, 20, 21, 22, 23, 24, 25, 26, 27, 28, 29, 30 or more contiguous amino acids from 158P3D2 v.1, v.3, v.4, v.10, v.12 and v.13; amino acids 1 to 236, or any 8, 9, 10, 11, 12, 13, 14, 15, 16, 17, 18, 19, 20, 21, 22, 23, 24, 25, 26, 27, 28, 29, 30 or more contiguous amino acids from 158P3D2v.2A; amino acids 1 to 181, or any 8, 9, 10, 11, 12, 13, 14, 15, 16, 17, 18, 19, 20, 21, 22, 23, 24, 25, 26, 27, 28, 29, 30 or more contiguous amino acids from 158P3D2 v.2B or v.5B; amino acids 1 to 178, or any 8, 9, 10, 11, 12, 13, 14, 15, 16, 17, 18, 19, 20, 21, 22, 23, 24, 25, 26, 27, 28, 29, 30 or more contiguous amino acids from 158P3D2 v.5A; amino acids 1 to 2036, or any 8, 9, 10, 11, 12, 13, 14, 15, 16, 17, 18, 19, 20, 21, 22, 23, 24, 25, 26, 27, 28, 29, 30 or more contiguous amino acids from 158P3D2 v.17; amino acids 1 to 1990, or any 8, 9, 10, 11, 12, 13, 14, 15, 16, 17, 18, 19, 20, 21, 22, 23, 24, 25, 26, 27, 28, 29, 30 or more contiguous amino acids from 158P3D2v.16; amino acids 1 to 1145, or any 8, 9, 10, 11, 12, 13, 14, 15, 16, 17, 18, 19, 20, 21, 22, 23, 24, 25, 26, 27, 28, 29, 30 or more contiguous amino acids from 158P3D2 v.15; amino acids 1 to 1393, or any 8, 9, 10, 11, 12, 13, 14, 15, 16, 17, 18, 19, 20, 21, 22, 23, 24, 25, 26, 27, 28, 29, 30 or more contiguous amino acids from 158P3D2 v.14; amino acids 1 to 610, or any 8, 9, 10, 11, 12, 13, 14, 15, 16, 17, 18, 19, 20, 21, 22, 23, 24, 25, 26, 27, 28, 29, 30 or more contiguous amino acids from 158P3D2v.18; or any 8, 9, 10, 11, 12, 13, 14, 15, 16, 17, 18, 19, 20, 21, 22, 23, 24, 25, 26, 27, 28, 29, 30 or more contiguous amino acids from 282P1G3 variants, or analogs thereof.

The constructs can be transfected into any one of a wide variety of mammalian cells such as 293T cells. Transfected 293T cell lysates can be probed with the anti-158P3D2 polyclonal serum, described herein.

pcDNA4/HisMax Constructs: To express 158P3D2 in mammalian cells, a 158P3D2 ORF, or portions thereof, of 158P3D2 are cloned into pcDNA4/HisMax Version A (Invitrogen, Carlsbad, Calif.). Protein expression is driven from the cytomegalovirus (CMV) promoter and the SP16 translational enhancer. The recombinant protein has Xpress™ and six histidine (6× His) epitopes fused to the amino-terminus. The pcDNA4/HisMax vector also contains the bovine growth hormone (BGH) polyadenylation signal and transcription termination sequence to enhance mRNA stability along with the SV40 origin for episomal replication and simple vector rescue in cell lines expressing the large T antigen. The Zeocin resistance gene allows for selection of mammalian cells expressing the protein and the ampicillin resistance gene and ColE1 origin permits selection and maintenance of the plasmid in E. coli.

pcDNA3.1/MycHis Constructs: To express 158P3D2 in mammalian cells, a 158P3D2 ORF, or portions thereof, of 158P3D2 with a consensus Kozak translation initiation site was cloned into pcDNA3.1/MycHis Version A (Invitrogen, Carlsbad, Calif.). Protein expression is driven from the cytomegalovirus (CMV) promoter. The recombinant proteins have the myc epitope and 6× His epitope fused to the carboxyl-terminus. The pcDNA3.1/MycHis vector also contains the bovine growth hormone (BGH) polyadenylation signal and transcription termination sequence to enhance mRNA stability, along with the SV40 origin for episomal replication and simple vector rescue in cell lines expressing the large T antigen. The Neomycin resistance gene can be used, as it allows for selection of mammalian cells expressing the protein and the ampicillin resistance gene and ColE1 origin permits selection and maintenance of the plasmid in E. coli. FIG. 19 shows expression of 158P3D2.pcDNA3.1/mychis in transiently transfected 293T cells.

pcDNA3.1/CT-GFP-TOPO Construct: To express 158P3D2 in mammalian cells and to allow detection of the recombinant proteins using fluorescence, a 158P3D2 ORF, or portions thereof, with a consensus Kozak translation initiation site are cloned into pcDNA3.1/CT-GFP-TOPO (Invitrogen, CA). Protein expression is driven from the cytomegalovirus (CMV) promoter. The recombinant proteins have the Green Fluorescent Protein (GFP) fused to the carboxyl-terminus facilitating non-invasive, in vivo detection and cell biology studies. The pcDNA3.1CT-GFP-TOPO vector also contains the bovine growth hormone (BGH) polyadenylation signal and transcription termination sequence to enhance mRNA stability along with the SV40 origin for episomal replication and simple vector rescue in cell lines expressing the large T antigen. The Neomycin resistance gene allows for selection of mammalian cells that express the protein, and the ampicillin resistance gene and ColE1 origin permits selection and maintenance of the plasmid in E. coli. Additional constructs with an amino-terminal GFP fusion are made in pcDNA3.1/NT-GFP-TOPO spanning the entire length of a 158P3D2 protein.

PAPtag: A 158P3D2 ORF, or portions thereof, is cloned into pAPtag-5 (GenHunter Corp. Nashville, Tenn.). This construct generates an alkaline phosphatase fusion at the carboxyl-terminus of a 158P3D2 protein while fusing the IgGκ signal sequence to the amino-terminus. Constructs are also generated in which alkaline phosphatase with an amino-terminal IgGκ signal sequence is fused to the amino-terminus of a 158P3D2 protein. The resulting recombinant 158P3D2 proteins are optimized for secretion into the media of transfected mammalian cells and can be used to identify proteins such as ligands or receptors that interact with 158P3D2 proteins. Protein expression is driven from the CMV promoter and the recombinant proteins also contain myc and 6× His epitopes fused at the carboxyl-terminus that facilitates detection and purification. The Zeocin resistance gene present in the vector allows for selection of mammalian cells expressing the recombinant protein and the ampicillin resistance gene permits selection of the plasmid in E. coli.

ptag5: A 158P3D2 ORF, or portions thereof, is cloned into pTag-5. This vector is similar to pAPtag but without the alkaline phosphatase fusion. This construct generates 158P3D2 protein with an amino-terminal IgGκ signal sequence and myc and 6× His epitope tags at the carboxyl-terminus that facilitate detection and affinity purification. The resulting recombinant 158P3D2 protein is optimized for secretion into the media of transfected mammalian cells, and is used as immunogen or ligand to identify proteins such as ligands or receptors that interact with the 158P3D2 proteins. Protein expression is driven from the CMV promoter. The Zeocin resistance gene present in the vector allows for selection of mammalian cells expressing the protein, and the ampicillin resistance gene permits selection of the plasmid in E. coli.

PsecFc: A 158P3D2 ORF, or portions thereof, is also cloned into psecFc. The psecFc vector was assembled by cloning the human immunoglobulin G1 (IgG) Fc (hinge, CH2, CH3 regions) into pSecTag2 (Invitrogen, California). This construct generates an IgG 1 Fc fusion at the carboxyl-terminus of the 158P3D2 proteins, while fusing the IgGκ signal sequence to N-terminus. 158P3D2 fusions utilizing the murine IgG1 Fc region are also used. The resulting recombinant 158P3D2 proteins are optimized for secretion into the media of transfected mammalian cells, and can be used as immunogens or to identify proteins such as ligands or receptors that interact with 158P3D2 protein. Protein expression is driven from the CMV promoter. The hygromycin resistance gene present in the vector allows for selection of mammalian cells that express the recombinant protein, and the ampicillin resistance gene permits selection of the plasmid in *E. coli*.

pSRα Constructs: To generate mammalian cell lines that express 158P3D2 constitutively, 158P3D2 ORF, or portions thereof, of 158P3D2 were cloned into pSRα constructs. Amphotropic and ecotropic retroviruses were generated by transfection of pSRα constructs into the 293T-10A 1 packaging line or co-transfection of pSRα and a helper plasmid (containing deleted packaging sequences) into the 293 cells, respectively. The retrovirus is used to infect a variety of mammalian cell lines, resulting in the integration of the cloned gene, 158P3D2, into the host cell-lines. Protein expression is driven from a long terminal repeat (LTR). The Neomycin resistance gene present in the vector allows for selection of mammalian cells that express the protein, and the ampicillin resistance gene and ColE1 origin permit selection and maintenance of the plasmid in *E. coli*. The retroviral vectors can thereafter be used for infection and generation of various cell lines using, for example, PC3, NIH 3T3, TsuPr1, 293 or rat-1 cells.

Additional pSRα constructs are made that fuse an epitope tag such as the FLAG™ tag to the carboxyl-terminus of 158P3D2 sequences to allow detection using anti-Flag antibodies. For example, the FLAG™ sequence 5' gat tac aag gat gac gac gat aag 3' (SEQ ID NO: 103) is added to cloning primer at the 3' end of the ORF. Additional pSRα constructs are made to produce both amino-terminal and carboxyl-terminal GFP and myc/6× His fusion proteins of the full-length 158P3D2 proteins.

Additional Viral Vectors: Additional constructs are made for viral-mediated delivery and expression of 158P3D2. High virus titer leading to high level expression of 158P3D2 is achieved in viral delivery systems such as adenoviral vectors and herpes amplicon vectors. A 158P3D2 coding sequences or fragments thereof are amplified by PCR and subcloned into the AdEasy shuttle vector (Stratagene). Recombination and virus packaging are performed according to the manufacturer's instructions to generate adenoviral vectors. Alternatively, 158P3D2 coding sequences or fragments thereof are cloned into the HSV-1 vector (Imgenex) to generate herpes viral vectors. The viral vectors are thereafter used for infection of various cell lines such as PC3, NIH 3T3, 293 or rat-1 cells.

Regulated Expression Systems: To control expression of 158P3D2 in mammalian cells, coding sequences of 158P3D2, or portions thereof, are cloned into regulated mammalian expression systems such as the T-Rex System (Invitrogen), the GeneSwitch System (Invitrogen) and the tightly-regulated Ecdysone System (Sratagene). These systems allow the study of the temporal and concentration dependent effects of recombinant 158P3D2. These vectors are thereafter used to control expression of 158P3D2 in various cell lines such as PC3, NIH 3T3, 293 or rat-1 cells.

B. Baculovirus Expression Systems

To generate recombinant 158P3D2 proteins in a baculovirus expression system, 158P3D2 ORF, or portions thereof, are cloned into the baculovirus transfer vector pBlueBac 4.5 (Invitrogen), which provides a His-tag at the N-terminus. Specifically, pBlueBac-158P3D2 is co-transfected with helper plasmid pBac-N-Blue (Invitrogen) into SF9 (*Spodoptera frugiperda*) insect cells to generate recombinant baculovirus (see Invitrogen instruction manual for details). Baculovirus is then collected from cell supernatant and purified by plaque assay.

Recombinant 158P3D2 protein is then generated by infection of HighFive insect cells (Invitrogen) with purified baculovirus. Recombinant 158P3D2 protein can be detected using anti-158P3D2 or anti-His-tag antibody. 158P3D2 protein can be purified and used in various cell-based assays or as immunogen to generate polyclonal and monoclonal antibodies specific for 158P3D2 which are used for diagnostic and therapeutic purposes.

Example 9

Antigenicity Profiles and Secondary Structure

FIG. 5A-I, FIG. 6A-I, FIG. 7A-I, FIG. 8A-I, and FIG. 9A-I depict graphically five amino acid profiles of 158P3D2 variants 1, 2a, 2b, 5a, 14, 15, 16, 17, 18, (A) through (I) respectively, each assessment available by accessing the ProtScale website on the ExPasy molecular biology server.

These profiles: FIG. 5, Hydrophilicity, (Hopp T. P., Woods K. R., 1981. Proc. Natl. Acad. Sci. U.S.A. 78:3824-3828); FIG. 6, Hydropathicity, (Kyte J., Doolittle R. F., 1982. J. Mol. Biol. 157:105-132); FIG. 7, Percentage Accessible Residues (Janin J., 1979 Nature 277:491-492); FIG. 8, Average Flexibility, (Bhaskaran R., and Ponnuswamy P. K., 1988. Int. J. Pept. Protein Res. 32:242-255); FIG. 9, Beta-turn (Deleage, G., Roux B. 1987 Protein Engineering 1:289-294); and optionally others available in the art, such as on the ProtScale website, were used to identify antigenic regions of each of the 158P3D2 variant proteins. Each of the above amino acid profiles of 158P3D2 variants were generated using the following ProtScale parameters for analysis: 1) A window size of 9; 2) 100% weight of the window edges compared to the window center; and, 3) amino acid profile values normalized to lie between 0 and 1.

Hydrophilicity (FIG. 5), Hydropathicity (FIG. 6) and Percentage Accessible Residues (FIG. 7) profiles were used to determine stretches of hydrophilic amino acids (i.e., values greater than 0.5 on the Hydrophilicity and Percentage Accessible Residues profile, and values less than 0.5 on the Hydropathicity profile). Such regions are likely to be exposed to the aqueous environment, be present on the surface of the protein, and thus available for immune recognition, such as by antibodies.

Average Flexibility (FIG. 8) and Beta-turn (FIG. 9) profiles determine stretches of amino acids (i.e., values greater than 0.5 on the Beta-turn profile and the Average Flexibility profile) that are not constrained in secondary structures such as beta sheets and alpha helices. Such regions are also more likely to be exposed on the protein and thus accessible to immune recognition, such as by antibodies.

Antigenic sequences of the 158P3D2 variant proteins indicated, e.g., by the profiles set forth in FIG. 5, FIG. 6, FIG. 7, FIG. 8, and/or FIG. 9 are used to prepare immunogens, either peptides or nucleic acids that encode them, to generate therapeutic and diagnostic anti-158P3D2 antibodies. The immunogen can be any 5, 6, 7, 8, 9, 10, 11, 12, 13, 14, 15, 16, 17, 18, 19, 20, 21, 22, 23, 24, 25, 30, 35, 40, 45, 50 or more than 50 contiguous amino acids, or the corresponding nucleic acids that encode them, from the 158P3D2 protein variants listed in FIGS. 2 and 3. In particular, peptide immunogens of the invention can comprise, a peptide region of at least 5 amino acids of FIGS. 2 and 3 in any whole number increment that includes an amino acid position having a value greater than 0.5 in the Hydrophilicity profiles of FIG. 5; a peptide region of at least 5 amino acids of FIGS. 2 and 3 in any whole number increment that includes an amino acid position having a value less than 0.5 in the Hydropathicity profile of FIG. 6; a peptide region of at least 5 amino acids of FIGS. 2 and 3 in any whole number increment that includes an amino acid position having a value greater than 0.5 in the Percent Accessible Residues profiles of FIG. 7; a peptide region of at least 5 amino acids of FIGS. 2 and 3 in any whole number increment that includes an amino acid position having a value greater than 0.5 in the Average Flexibility profiles on FIG. 8; and, a peptide region of at least 5 amino acids of FIGS. 2 and 3 in any whole number increment that includes an amino acid position having a value greater than 0.5 in the Beta-turn profile of FIG. 9. Peptide immunogens of the invention can also comprise nucleic acids that encode any of the forgoing.

All immunogens of the invention, peptide or nucleic acid, can be embodied in human unit dose form, or comprised by a composition that includes a pharmaceutical excipient compatible with human physiology.

The secondary structures of 158P3D2 protein variants 1, 2a, 2b, 5a, 14, 15, 16, 17, and 18, namely the predicted presence and location of alpha helices, extended strands, and random coils, are predicted from their primary amino acid sequences using the HNN—Hierarchical Neural Network method (NPS@: Network Protein Sequence Analysis TIBS 2000 March Vol. 25, No 3 [291]:147-150 Combet C., Blanchet C., Geourjon C. and Deléage G., accessed from the ExPasy molecular biology server. The analysis indicates that 158P3D2 variant 1 is composed of 32.93% alpha helix, 18.29% extended strand, and 48.78% random coil (FIG. 13A). 158P3D2 variant 2a is composed of 25.58% alpha helix, 18.22% extended strand, and 55.93% random coil (FIG. 13B). 158P3D2 variant 2b is composed of 44.75% alpha helix, 11.60% extended strand, and 43.65% random coil (FIG. 13C). 158P3D2 variant 5a is composed of 9.55% alpha helix, 26.40% extended strand, and 64.04% random coil (FIG. 13D). 158P3D2 variant 14 is composed of 33.88% alpha helix, 13.42% extended strand, and 52.69% random coil (FIG. 13E). 158P3D2 variant 15 is composed of 33.28% alpha helix, 15.11% extended strand, and 51.62% random coil (FIG. 13F). 158P3D2 variant 16 is composed of 32.76% alpha helix, 14.47% extended strand, and 52.76% random coil (FIG. 13G). 158P3D2 variant 17 is composed of 32.86% alpha helix, 14.69% extended strand, and 52.46% random coil (FIG. 13H). 158P3D2 variant 18 is composed of 27.21% alpha helix, 14.75% extended strand, and 58.03% random coil (FIG. 13I).

Analysis for the potential presence of transmembrane domains in the 158P3D2 variant proteins 1, 2a, 2b, 5a, 14, 15, 16, 17, and 18, was carried out using a variety of transmembrane prediction algorithms accessed from the ExPasy molecular biology server. Shown graphically in FIGS. 13L, 13N, 13P, 13R, 13T, 13V, 13X, 13Z are the results of analysis of variants 1, 2a, 2b, 5a, 14, 15, 16, 17, and 18, respectively, using the TMpred program. Shown graphically in FIGS. 13K, 13M, 13O, 13Q, 13S, 13U, 13W, 13Y, 13AA are the results of analysis of variants 1, 2a, 2b, 5a, 14, 15, 16, 17, and 18, respectively using the TMHMM program. Both programs predict the presence of 1 transmembrane domain in variant 1. Both programs predict that variants 2a, 2b, 5a, and 18 lack transmembrane domains and are soluble proteins. The TMpred program predicts that variants 14, 15, 16, and 17 have 2 transmembrane domains of which the more carboxy-terminal transmembrane has a higher probability of existence. The TMHMM program predicts that variants 14 and 15 do not encode transmembrane domains and variants 16 and 17 contain 1 transmembrane domain. Analyses of the variants using other structural prediction programs are summarized in Table VI and Table L.

Example 10

Generation of 158P3D2 Polyclonal Antibodies

Polyclonal antibodies can be raised in a mammal, for example, by one or more injections of an immunizing agent and, if desired, an adjuvant. Typically, the immunizing agent and/or adjuvant will be injected in the mammal by multiple subcutaneous or intraperitoneal injections. In addition to immunizing with a full length 158P3D2 protein variant, computer algorithms are employed in design of immunogens that, based on amino acid sequence analysis contain characteristics of being antigenic and available for recognition by the immune system of the immunized host (see the Example entitled "Antigenicity Profiles and Secondary Structure"). Such regions would be predicted to be hydrophilic, flexible, in beta-turn conformations, and be exposed on the surface of the protein (see, e.g., FIG. 5, FIG. 6, FIG. 7, FIG. 8, or FIG. 9 for amino acid profiles that indicate such regions of 158P3D2 protein variant 1 or other protein variants).

For example, recombinant bacterial fusion proteins or peptides containing hydrophilic, flexible, beta-turn regions of 158P3D2 protein variants are used as antigens to generate polyclonal antibodies in New Zealand White rabbits or monoclonal antibodies as described in Example 11 ("Generation of Monoclonal Antibodies"). For example, in 158P3D2 variant 1, such regions include, but are not limited to, amino acids 1-25, amino acids 37-54, amino acids 60-73, amino acids 187-225, and amino acids 235-271. An extracellular epitope peptide encoding amino acids 315 to 328 is also used to generate antibodies that bind to the extracellular region of 158P3D2 protein. It is useful to conjugate the immunizing agent to a protein known to be immunogenic in the mammal being immunized. Examples of such immunogenic proteins include, but are not limited to, keyhole limpet hemocyanin (KLH), serum albumin, bovine thyroglobulin, and soybean trypsin inhibitor. In one embodiment, a peptide encoding amino acids 315-328 of 158P3D2 variant 1 was conjugated to KLH and used to immunize a rabbit. Alternatively the immunizing agent may include all or portions of the 158P3D2 variant proteins, analogs or fusion proteins thereof. For example, the 158P3D2 variant 1 amino acid sequence can be fused using recombinant DNA techniques to any one of a variety of fusion protein partners that are well known in the art, such as glutathione-S-transferase (GST) and HIS tagged fusion proteins.

In one embodiment, amino acids 155-290 of 158P3D2 variant 1 were fused to His using recombinant techniques and the pET21b expression vector. In another embodiment, amino acids 260-328 were cloned into the pET21b expression vector. The proteins are then expressed, purified, and used to immunize rabbits. Such fusion proteins are purified from induced bacteria using the appropriate affinity matrix.

Other recombinant bacterial fusion proteins that may be employed include maltose binding protein, LacZ, thioredoxin, NusA, or an immunoglobulin constant region (see the section entitled "Production of 158P3D2 in Prokaryotic Systems" and Current Protocols In Molecular Biology, Volume 2, Unit 16, Frederick M. Ausubul et al. eds., 1995; Linsley, P.S., Brady, W., Urnes, M., Grosmaire, L., Damle, N., and Ledbetter, L. (1991) J. Exp. Med. 174, 561-566).

In addition to bacterial derived fusion proteins, mammalian expressed protein antigens are also used. These antigens are expressed from mammalian expression vectors such as the Tag5 and Fc-fusion vectors (see the section entitled "Production of Recombinant 158P3D2 in Eukaryotic Systems"), and retain post-translational modifications such as glycosylations found in native protein. In one embodiment, amino acids 1-236 of 158P3D2 variant 2a is cloned into the Tag5 mammalian secretion vector, and expressed in 293T cells. The recombinant protein is purified by metal chelate chromatography from tissue culture supernatants of 293T cells stably expressing the recombinant vector. The purified Tag5 158P3D2 protein is then used as immunogen.

During the immunization protocol, it is useful to mix or emulsify the antigen in adjuvants that enhance the immune response of the host animal. Examples of adjuvants include, but are not limited to, complete Freund's adjuvant (CFA) and MPL-TDM adjuvant (monophosphoryl Lipid A, synthetic trehalose dicorynomycolate).

In a typical protocol, rabbits are initially immunized subcutaneously with up to 200 µg, typically 100-200 µg, of fusion protein or peptide conjugated to KLH mixed in complete Freund's adjuvant (CFA). Rabbits are then injected subcutaneously every two weeks with up to 200 µg, typically 100-200 µg, of the immunogen in incomplete Freund's adjuvant (IFA). Test bleeds are taken approximately 7-10 days following each immunization and used to monitor the titer of the antiserum by ELISA.

To test reactivity and specificity of immune serum, such a rabbit serum derived from immunization with the His-fusion of 158P3D2 variant 1 protein, the full-length 158P3D2 variant 1 cDNA was cloned into pcDNA 3.1 myc-his expression vector (Invitrogen, see the Example entitled "Production of Recombinant 158P3D2 in Eukaryotic Systems"). After transfection of the constructs into 293T cells, cell lysates are probed with the anti-158P3D2 serum and with anti-His antibody (Santa Cruz Biotechnologies, Santa Cruz, Calif.) to determine specific reactivity to denatured 158P3D2 protein using the Western blot technique. In addition, the immune serum is tested by fluorescence microscopy, flow cytometry and immunoprecipitation against 293T and other recombinant 158P3D2-expressing cells to determine specific recognition of native protein. Western blot, immunoprecipitation, fluorescent microscopy, and flow cytometric techniques using cells that endogenously express 158P3D2 are also carried out to test reactivity and specificity.

Anti-serum from rabbits immunized with 158P3D2 variant fusion proteins, such as GST and MBP fusion proteins, are purified by depletion of antibodies reactive to the fusion partner sequence by passage over an affinity column containing the fusion partner either alone or in the context of an irrelevant fusion protein. For example, antiserum derived from a GST-158P3D2 variant 1 fusion protein is first purified by passage over a column of GST protein covalently coupled to AffiGel matrix (BioRad, Hercules, Calif.). The antiserum is then affinity purified by passage over a column composed of a MBP-158P3D2 fusion protein covalently coupled to Affigel matrix. The serum is then further purified by protein G affinity chromatography to isolate the IgG fraction. Sera from other His-tagged antigens and peptide immunized rabbits as well as fusion partner depleted sera are affinity purified by passage over a column matrix composed of the original protein immunogen or free peptide.

Example 11

Generation of 158P3D2 Monoclonal Antibodies (mAbs)

In one embodiment, therapeutic mAbs to 158P3D2 variants comprise those that react with epitopes specific for each variant protein or specific to sequences in common between the variants that would disrupt or modulate the biological function of the 158P3D2 variants, for example those that would disrupt the interaction with ligands and binding partners. Immunogens for generation of such mAbs include those designed to encode or contain the entire 158P3D2 protein variant sequence, regions predicted to contain functional motifs, and regions of the 158P3D2 protein variants predicted to be antigenic from computer analysis of the amino acid sequence (see, e.g., FIG. 5, FIG. 6, FIG. 7, FIG. 8, or FIG. 9, and the Example entitled "Antigenicity Profiles and Secondary Structure"). Immunogens include peptides, recombinant bacterial proteins, and mammalian expressed Tag 5 proteins and human and murine IgG FC fusion proteins. In addition, cells engineered to express high levels of a respective 158P3D2 variant, such as Rat1-158P3D2 variant 1 or 300.19-158P3D2 variant 1 murine Pre-B cells, were used to immunize mice.

To generate mAbs to a 158P3D2 variant, mice are first immunized intraperitoneally (IP) with, typically, 10-50 µg of protein immunogen or $10^7$ 158P3D2-expressing cells mixed in complete Freund's adjuvant. Mice are then subsequently immunized IP every 2-4 weeks with, typically, 10-50 µg of protein immunogen or $10^7$ cells mixed in incomplete Freund's adjuvant. Alternatively, MPL-TDM adjuvant is used in immunizations. In addition to the above protein and cell-based immunization strategies, a DNA-based immunization protocol is employed in which a mammalian expression vector encoding a 158P3D2 variant sequence is used to immunize mice by direct injection of the plasmid DNA. For example, amino acids 1-400 of 158P3D2 of variant 15 is cloned into the Tag5 mammalian secretion vector and the recombinant vector will then be used as immunogen. In another example the same amino acids are cloned into an Fc-fusion secretion vector in which the 158P3D2 variant 15 sequence is fused at the amino-terminus to an IgK leader sequence and at the carboxyl-terminus to the coding sequence of the human or murine IgG Fc region. This recombinant vector is then used as immunogen. The plasmid immunization protocols are used in combination with purified proteins expressed from the same vector and with cells expressing the respective 158P3D2 variant.

During the immunization protocol, test bleeds are taken 7-10 days following an injection to monitor titer and specificity of the immune response. Once appropriate reactivity and specificity is obtained as determined by ELISA, Western blotting, immunoprecipitation, fluorescence microscopy, and flow cytometric analyses, fusion and hybridoma generation is then carried out with established procedures well known in the art (see, e.g., Harlow and Lane, 1988).

In one embodiment for generating 158P3D2 monoclonal antibodies, a peptide encoding amino acids 315-328 of 158P3D2 variant 1 was coupled to KLH and use to immunize mice. Balb C mice were immunized with 10 µg of the KLH-peptide mixed in adjuvant. Mice were subsequently immunized over several weeks with the KLH-peptide. ELISA using the peptide coupled to a different carrier, ovalbumin, determined the titer of serum from the immunized mice (See FIG. 29). Reactivity and specificity of the serum to full length 158P3D2 variant 1 protein was monitored by flow cytometry and Western blotting using recombinant 158P3D2 variant 1-expressing cells and cells endogenously expressing 158P3D2 variant 1 protein. Mice showing the strongest reactivity were rested and given a final injection of antigen and sacrificed for fusion. The lymph nodes of the sacrificed mice were harvested and fused to SPO/2 myeloma cells using standard procedures (Harlow and Lane, 1988). Supernatants from HAT selected growth wells were analyzed by flow cytometry to identify specific-158P3D2 surface binding MAbs. Supernatants were also screened by ELISA, Western blot, immunoprecipitation, and fluorescent microscopy to identify 158P3D2 specific antibody-producing clones.

In other embodiments, 158P3D2 variant specific MAbs are generated by employing immunogens that encode amino acid sequences unique to each variant or created by unique junctions from alternative splicing of exons. For example, a peptide encoding amino acids 1018-1035 of 158P3D2 variant 15 is coupled to KLH and used to immunize mice. In another example, amino acids 1375-1393 of 158P3D2 variant 14 is coupled to KLH and used to immunize mice. Hybridomas resulting from fusion of the B-cells from the mice are screened on cells expressing the respective 158P3D2 variant protein from which the antigen was derived and cross-screened on cells expressing the other variant proteins to identify variant specific MAbs and MAbs that may recognize more than 1 variant.

The binding affinity of 158P3D2 variant specific monoclonal antibodies was determined using standard technologies. Affinity measurements quantify the strength of antibody to epitope binding and are used to help define which 158P3D2 variant monoclonal antibodies preferred for diagnostic or therapeutic use, as appreciated by one of skill in the art. The BIAcore system (Uppsala, Sweden) is a preferred method for determining binding affinity. The BIAcore system uses surface plasmon resonance (SPR, Welford K. 1991, Opt. Quant. Elect. 23:1; Morton and Myszka, 1998, Methods in Enzymology 295: 268) to monitor biomolecular interactions in real time. BIAcore analysis conveniently generates association rate constants, dissociation rate constants, equilibrium dissociation constants, and affinity constants.

In addition, equilibrium binding analysis of a dilution series of the MAb was also used to determine affinity defined by the dissociation constant (KD). The KD is determined by non-linear regression of the equilibrium binding data of the concentration series. The KD is defined as the concentration at which half-maximal binding of the MAb to the antigen is attained under equilibrium conditions.

Example 12

HLA Class I and Class II Binding Assays

HLA class I and class II binding assays using purified HLA molecules are performed in accordance with disclosed protocols (e.g., PCT publications WO 94/20127 and WO 94/03205; Sidney et al., Current Protocols in Immunology 18.3.1 (1998); Sidney, et al., J. Immunol. 154:247 (1995); Sette, et al., Mol. Immunol. 31:813 (1994)). Briefly, purified MHC molecules (5 to 500 nM) are incubated with various unlabeled peptide inhibitors and 1-10 nM 125I-radiolabeled probe peptides as described. Following incubation, MHC-peptide complexes are separated from free peptide by gel filtration and the fraction of peptide bound is determined. Typically, in preliminary experiments, each MHC preparation is titered in the presence of fixed amounts of radiolabeled peptides to determine the concentration of HLA molecules necessary to bind 10-20% of the total radioactivity. All subsequent inhibition and direct binding assays are performed using these HLA concentrations.

Since under these conditions [label]<[HLA] and IC50≧[HLA], the measured IC50 values are reasonable approximations of the true KD values. Peptide inhibitors are typically tested at concentrations ranging from 120 µg/ml to 1.2 ng/ml, and are tested in two to four completely independent experiments. To allow comparison of the data obtained in different experiments, a relative binding figure is calculated for each peptide by dividing the IC50 of a positive control for inhibition by the IC50 for each tested peptide (typically unlabeled versions of the radiolabeled probe peptide). For database purposes, and inter-experiment comparisons, relative binding values are compiled. These values can subsequently be converted back into IC50 nM values by dividing the IC50 nM of the positive controls for inhibition by the relative binding of the peptide of interest. This method of data compilation is accurate and consistent for comparing peptides that have been tested on different days, or with different lots of purified MHC.

Binding assays as outlined above may be used to analyze HLA supermotif and/or HLA motif-bearing peptides (see Table IV).

Example 13

Identification of HLA Supermotif- and Motif-Bearing CTL Candidate Epitopes

HLA vaccine compositions of the invention can include multiple epitopes. The multiple epitopes can comprise multiple HLA supermotifs or motifs to achieve broad population coverage. This example illustrates the identification and confirmation of supermotif- and motif-bearing epitopes for the inclusion in such a vaccine composition. Calculation of population coverage is performed using the strategy described below.

Computer Searches and Algorithms for Identification of Supermotif and/or Motif-Bearing Epitopes The searches performed to identify the motif-bearing peptide sequences in the Example entitled "Antigenicity Profiles" and Tables VIII-XXI and XXII-XLIX employ the protein sequence data from the gene product of 158P3D2 set forth in FIGS. 2 and 3, the specific search peptides used to generate the tables are listed in Table VII.

Computer searches for epitopes bearing HLA Class I or Class II supermotifs or motifs are performed as follows. All translated 158P3D2 protein sequences are analyzed using a text string search software program to identify potential peptide sequences containing appropriate HLA binding motifs; such programs are readily produced in accordance with information in the art in view of known motif/supermotif disclosures. Furthermore, such calculations can be made mentally.

Identified A2-, A3-, and DR-supermotif sequences are scored using polynomial algorithms to predict their capacity to bind to specific HLA-Class I or Class II molecules. These polynomial algorithms account for the impact of different amino acids at different positions, and are essentially based on the premise that the overall affinity (or ΔG) of peptide-HLA molecule interactions can be approximated as a linear polynomial function of the type:

"ΔG"=a1i×a2i×a3i . . . ×ani where aji is a coefficient which represents the effect of the presence of a given amino acid (j) at a given position (i) along the sequence of a peptide of n amino acids. The crucial assumption of this method is that the effects at each position are essentially independent of each other (i.e., independent binding of individual side-chains). When residue j occurs at position i in the peptide, it is assumed to contribute a constant amount ji to the free energy of binding of the peptide irrespective of the sequence of the rest of the peptide.

The method of derivation of specific algorithm coefficients has been described in Gulukota et al., J. Mol. Biol. 267:1258-126, 1997; (see also Sidney et al., Human Immunol. 45:79-93, 1996; and Southwood et al., J. Immunol. 160:3363-3373, 1998). Briefly, for all i positions, anchor and non-anchor alike, the geometric mean of the average relative binding (ARB) of all peptides carrying j is calculated relative to the remainder of the group, and used as the estimate of ji. For Class II peptides, if multiple alignments are possible, only the highest scoring alignment is utilized, following an iterative procedure. To calculate an algorithm score of a given peptide in a test set, the ARB values corresponding to the sequence of the peptide are multiplied. If this product exceeds a chosen threshold, the peptide is predicted to bind. Appropriate thresholds are chosen as a function of the degree of stringency of prediction desired.

Selection of HLA-A2 Supertype Cross-Reactive Peptides

Protein sequences from 158P3D2 are scanned utilizing motif identification software, to identify 8-, 9-10- and 11-mer sequences containing the HLA-A2-supermotif main anchor specificity. Typically, these sequences are then scored using the protocol described above and the peptides corresponding to the positive-scoring sequences are synthesized and tested for their capacity to bind purified HLA-A*0201 molecules in vitro (HLA-A*0201 is considered a prototype A2 supertype molecule).

These peptides are then tested for the capacity to bind to additional A2-supertype molecules (A*0202, A*0203, A*0206, and A*6802). Peptides that bind to at least three of the five A2-supertype alleles tested are typically deemed A2-supertype cross-reactive binders. Preferred peptides bind at an affinity equal to or less than 500 nM to three or more HLA-A2 supertype molecules.

Selection of HLA-A3 Supermotif-Bearing Epitopes

The 158P3D2 protein sequence(s) scanned above is also examined for the presence of peptides with the HLA-A3-supermotif primary anchors. Peptides corresponding to the HLA A3 supermotif-bearing sequences are then synthesized and tested for binding to HLA-A*0301 and HLA-A*1101 molecules, the molecules encoded by the two most prevalent A3-supertype alleles. The peptides that bind at least one of the two alleles with binding affinities of ≦500 nM, often ≦200 nM, are then tested for binding cross-reactivity to the other common A3-supertype alleles (e.g., A*3101, A*3301, and A*6801) to identify those that can bind at least three of the five HLA-A3-supertype molecules tested.

Selection of HLA-B7 Supermotif Bearing Epitopes

The 158P3D2 protein(s) scanned above is also analyzed for the presence of 8-, 9-10-, or 11-mer peptides with the HLA-B7-supermotif. Corresponding peptides are synthesized and tested for binding to HLA-B*0702, the molecule encoded by the most common B7-supertype allele (i.e., the prototype B7 supertype allele). Peptides binding B*0702 with IC50 of ≦500 nM are identified using standard methods. These peptides are then tested for binding to other common B7-supertype molecules (e.g., B*3501, B*5101, B*5301, and B*5401). Peptides capable of binding to three or more of the five B7-supertype alleles tested are thereby identified.

Selection of A1 and A24 Motif-Bearing Epitopes

To further increase population coverage, HLA-A1 and -A24 epitopes can also be incorporated into vaccine compositions. An analysis of the 158P3D2 protein can also be performed to identify HLA-A1- and A24-motif-containing sequences.

High affinity and/or cross-reactive binding epitopes that bear other motif and/or supermotifs are identified using analogous methodology.

Example 14

Confirmation of Immunogenicity

Cross-reactive candidate CTL A2-supermotif-bearing peptides that are identified as described herein are selected to confirm in vitro immunogenicity. Confirmation is performed using the following methodology:

Target Cell Lines for Cellular Screening:

The 0.221A2.1 cell line, produced by transferring the HLA-A2.1 gene into the HLA-A, -B, -C null mutant human B-lymphoblastoid cell line 721.221, is used as the peptide-loaded target to measure activity of HLA-A2.1-restricted CTL. This cell line is grown in RPMI-1640 medium supplemented with antibiotics, sodium pyruvate, nonessential amino acids and 10% (v/v) heat inactivated FCS. Cells that express an antigen of interest, or transfectants comprising the gene encoding the antigen of interest, can be used as target cells to confirm the ability of peptide-specific CTLs to recognize endogenous antigen.

Primary CTL Induction Cultures:

Generation of Dendritic Cells (DC): PBMCs are thawed in RPMI with 30 µg/ml DNAse, washed twice and resuspended in complete medium (RPMI-1640 plus 5% AB human serum, non-essential amino acids, sodium pyruvate, L-glutamine and penicillin/streptomycin). The monocytes are purified by plating 10×106 PBMC/well in a 6-well plate. After 2 hours at 37° C., the non-adherent cells are removed by gently shaking the plates and aspirating the supernatants. The wells are washed a total of three times with 3 ml RPMI to remove most of the non-adherent and loosely adherent cells. Three ml of complete medium containing 50 ng/ml of GM-CSF and 1,000 U/ml of IL-4 are then added to each well. TNFα is added to the DCs on day 6 at 75 ng/ml and the cells are used for CTL induction cultures on day 7.

Induction of CTL with DC and Peptide: CD8+ T-cells are isolated by positive selection with Dynal immunomagnetic beads (Dynabeads® M-450) and the Detacha-Bead® reagent. Typically about 200-250×106 PBMC are processed to obtain 24×106 CD8+ T-cells (enough for a 48-well plate culture). Briefly, the PBMCs are thawed in RPMI with 30 µg/ml DNAse, washed once with PBS containing 1% human AB serum and resuspended in PBS/1% AB serum at a concentration of 20×106 cells/ml. The magnetic beads are washed 3 times with PBS/AB serum, added to the cells (140 µl beads/20×106 cells) and incubated for 1 hour at 4° C. with continuous mixing. The beads and cells are washed 4× with PBS/AB serum to remove the nonadherent cells and resuspended at 100×106 cells/ml (based on the original cell number) in PBS/AB serum containing 100 µl/ml Detacha-Bead® reagent and 30 µg/ml DNAse. The mixture is incubated for 1 hour at room temperature with continuous mixing. The beads are washed again with PBS/AB/DNAse to collect the CD8+ T-cells. The DC are collected and centrifuged at 1300 rpm for 5-7 minutes, washed once with PBS with 1% BSA, counted and pulsed with µg/ml of peptide at a cell concentration of 1-2×106/ml in the presence of 3 µg/ml B2-microglobulin for 4 hours at 20° C. The DC are then irradiated (4,200 rads), washed 1 time with medium and counted again.

Setting up induction cultures: 0.25 ml cytokine-generated DC (at 1×105 cells/ml) are co-cultured with 0.25 ml of CD8+ T-cells (at 2×106 cell/ml) in each well of a 48-well plate in the presence of 10 ng/ml of IL-7. Recombinant human IL-10 is added the next day at a final concentration of 10 ng/ml and rhuman IL-2 is added 48 hours later at 10 IU/ml.

Restimulation of the induction cultures with peptide-pulsed adherent cells: Seven and fourteen days after the primary induction, the cells are restimulated with peptide-pulsed adherent cells. The PBMCs are thawed and washed twice with RPMI and DNAse. The cells are resuspended at 5×106 cells/ml and irradiated at ~4200 rads. The PBMCs are plated at 2×106 in 0.5 ml complete medium per well and incubated for 2 hours at 37° C. The plates are washed twice with RPMI by tapping the plate gently to remove the nonadherent cells and the adherent cells pulsed with 10 µg/ml of peptide in the presence of 3 µg/ml β2 microglobulin in 0.25 ml RPMI/5% AB per well for 2 hours at 37° C. Peptide solution from each well is aspirated and the wells are washed once with RPMI. Most of the media is aspirated from the induction cultures (CD8+ cells) and brought to 0.5 ml with fresh media. The cells are then transferred to the wells containing the peptide-pulsed adherent cells. Twenty four hours later recombinant human IL-10 is added at a final concentration of 10 ng/ml and recombinant human IL2 is added the next day and again 2-3 days later at 50 IU/ml (Tsai et al., Critical Reviews in Immunology 18(1-2):65-75, 1998). Seven days later, the cultures are assayed for CTL activity in a 51 Cr release assay. In some experiments the cultures are assayed for peptide-specific recognition in the in situ IFNγ ELISA at the time of the second restimulation followed by assay of endogenous recognition 7 days later. After expansion, activity is measured in both assays for a side-by-side comparison.

Measurement of CTL Lytic Activity by 51Cr Release.

Seven days after the second restimulation, cytotoxicity is determined in a standard (5 hr) 51Cr release assay by assaying individual wells at a single E:T. Peptide-pulsed targets are prepared by incubating the cells with 10 µg/ml peptide overnight at 37° C.

Adherent target cells are removed from culture flasks with trypsin-EDTA. Target cells are labeled with 200 µCi of 51Cr sodium chromate (Dupont, Wilmington, Del.) for 1 hour at 37° C. Labeled target cells are resuspended at 106 per ml and diluted 1:10 with K562 cells at a concentration of 3.3×106/ml (an NK-sensitive erythroblastoma cell line used to reduce non-specific lysis). Target cells (100 µl) and effectors (100 µl) are plated in 96 well round-bottom plates and incubated for 5 hours at 37° C. At that time, 100 µl of supernatant are collected from each well and percent lysis is determined according to the formula:

[(cpm of the test sample−cpm of the spontaneous 51Cr release sample)/(cpm of the maximal 51Cr release sample−cpm of the spontaneous 51Cr release sample)]×100.

Maximum and spontaneous release are determined by incubating the labeled targets with 1% Triton X-100 and media alone, respectively. A positive culture is defined as one in which the specific lysis (sample-background) is 10% or higher in the case of individual wells and is 15% or more at the two highest E:T ratios when expanded cultures are assayed.

In Situ Measurement of Human IFNγ Production as an Indicator of Peptide-Specific and Endogenous Recognition Immulon 2 plates are coated with mouse anti-human IFNγ monoclonal antibody (4 µg/ml 0.1M NaHCO3, pH8.2) overnight at 4° C. The plates are washed with Ca2+, Mg2+-free PBS/0.05% Tween 20 and blocked with PBS/10% FCS for two hours, after which the CTLs (100 µl/well) and targets (100 l/well) are added to each well, leaving empty wells for the standards and blanks (which received media only). The target cells, either peptide-pulsed or endogenous targets, are used at a concentration of 1×106 cells/ml. The plates are incubated for 48 hours at 37° C. with 5% $CO_2$.

Recombinant human IFN-gamma is added to the standard wells starting at 400 pg or 1200 µg/100 microliter/well and the plate incubated for two hours at 37° C. The plates are washed and 100 µl of biotinylated mouse anti-human IFN-gamma monoclonal antibody (2 microgram/ml in PBS/3% FCS/0.05% Tween 20) are added and incubated for 2 hours at room temperature. After washing again, 100 microliter HRP-streptavidin (1:4000) are added and the plates incubated for one hour at room temperature. The plates are then washed 6× with wash buffer, 100 microliter/well developing solution (TMB 1:1) are added, and the plates allowed to develop for 5-15 minutes. The reaction is stopped with 50 microliter/well 1M H3PO4 and read at OD450. A culture is considered positive if it measured at least 50 pg of IFN-gamma/well above background and is twice the background level of expression.

CTL Expansion.

Those cultures that demonstrate specific lytic activity against peptide-pulsed targets and/or tumor targets are expanded over a two week period with anti-CD3. Briefly, 5×104 CD8+ cells are added to a T25 flask containing the following: 1×106 irradiated (4,200 rad) PBMC (autologous or allogeneic) per ml, 2×105 irradiated (8,000 rad) EBV-transformed cells per ml, and OKT3 (anti-CD3) at 30 ng per ml in RPMI-1640 containing 10% (v/v) human AB serum, non-essential amino acids, sodium pyruvate, 25 µM 2-mercaptoethanol, L-glutamine and penicillin/streptomycin. Recombinant human IL2 is added 24 hours later at a final concentration of 200 IU/ml and every three days thereafter with fresh media at 50 IU/ml. The cells are split if the cell concentration exceeds 1×106/ml and the cultures are assayed between days 13 and 15 at E:T ratios of 30, 10, 3 and 1:1 in the 51Cr release assay or at 1×106/ml in the in situ IFNγ assay using the same targets as before the expansion.

Cultures are expanded in the absence of anti-CD3+ as follows. Those cultures that demonstrate specific lytic activity against peptide and endogenous targets are selected and 5×104 CD8+ cells are added to a T25 flask containing the following: 1×106 autologous PBMC per ml which have been peptide-pulsed with 10 µg/ml peptide for two hours at 37° C. and irradiated (4,200 rad); 2×105 irradiated (8,000 rad) EBV-transformed cells per ml RPMI-1640 containing 10% (v/v) human AB serum, non-essential AA, sodium pyruvate, 25 mM 2-ME, L-glutamine and gentamicin.

Immunogenicity of A2 Supermotif-Bearing Peptides

A2-supermotif cross-reactive binding peptides are tested in the cellular assay for the ability to induce peptide-specific CTL in normal individuals. In this analysis, a peptide is typically considered to be an epitope if it induces peptide-specific CTLs in at least individuals, and preferably, also recognizes the endogenously expressed peptide.

Immunogenicity can also be confirmed using PBMCs isolated from patients bearing a tumor that expresses 158P3D2. Briefly, PBMCs are isolated from patients, re-stimulated with peptide-pulsed monocytes and assayed for the ability to recognize peptide-pulsed target cells as well as transfected cells endogenously expressing the antigen.

Evaluation of A*03/A11 Immunogenicity

HLA-A3 supermotif-bearing cross-reactive binding peptides are also evaluated for immunogenicity using methodology analogous for that used to evaluate the immunogenicity of the HLA-A2 supermotif peptides.

Evaluation of B7 Immunogenicity

Immunogenicity screening of the B7-supertype cross-reactive binding peptides identified as set forth herein are confirmed in a manner analogous to the confirmation of A2- and A3-supermotif-bearing peptides.

Peptides bearing other supermotifs/motifs, e.g., HLA-A1, HLA-A24 etc. are also confirmed using similar methodology.

Example 15

Implementation of the Extended Supermotif to Improve the Binding Capacity of Native Epitopes by Creating Analogs HLA motifs and supermotifs (comprising primary and/or secondary residues) are useful in the identification and preparation of highly cross-reactive native peptides, as demonstrated herein. Moreover, the definition of HLA motifs and supermotifs also allows one to engineer highly cross-reactive epitopes by identifying residues within a native peptide sequence which can be analoged to confer upon the peptide certain characteristics, e.g. greater cross-reactivity within the group of HLA molecules that comprise a supertype, and/or greater binding affinity for some or all of those HLA molecules. Examples of analoging peptides to exhibit modulated binding affinity are set forth in this example.

Analoging at Primary Anchor Residues

Peptide engineering strategies are implemented to further increase the cross-reactivity of the epitopes. For example, the main anchors of A2-supermotif-bearing peptides are altered, for example, to introduce a preferred L, I, V, or M at position 2, and I or V at the C-terminus.

To analyze the cross-reactivity of the analog peptides, each engineered analog is initially tested for binding to the prototype A2 supertype allele A*0201, then, if A*0201 binding capacity is maintained, for A2-supertype cross-reactivity.

Alternatively, a peptide is confirmed as binding one or all supertype members and then analoged to modulate binding affinity to any one (or more) of the supertype members to add population coverage.

The selection of analogs for immunogenicity in a cellular screening analysis is typically further restricted by the capacity of the parent wild type (WT) peptide to bind at least weakly, i.e., bind at an IC50 of 500 nM or less, to three of more A2 supertype alleles. The rationale for this requirement is that the WT peptides must be present endogenously in sufficient quantity to be biologically relevant. Analoged peptides have been shown to have increased immunogenicity and cross-reactivity by T cells specific for the parent epitope (see, e.g., Parkhurst et al., J. Immunol. 157:2539, 1996; and Pogue et al., Proc. Natl. Acad. Sci. USA 92:8166, 1995).

In the cellular screening of these peptide analogs, it is important to confirm that analog-specific CTLs are also able to recognize the wild-type peptide and, when possible, target cells that endogenously express the epitope.

Analoging of HLA-A3 and B7-Supermotif-Bearing Peptides

Analogs of HLA-A3 supermotif-bearing epitopes are generated using strategies similar to those employed in analoging HLA-A2 supermotif-bearing peptides. For example, peptides binding to 3/5 of the A3-supertype molecules are engineered at primary anchor residues to possess a preferred residue (V, S, M, or A) at position 2.

The analog peptides are then tested for the ability to bind A*03 and A*11 (prototype A3 supertype alleles). Those peptides that demonstrate ≦500 nM binding capacity are then confirmed as having A3-supertype cross-reactivity.

Similarly to the A2- and A3-motif bearing peptides, peptides binding 3 or more B7-supertype alleles can be improved, where possible, to achieve increased cross-reactive binding or greater binding affinity or binding half life. B7 supermotif-bearing peptides are, for example, engineered to possess a preferred residue (V, I, L, or F) at the C-terminal primary anchor position, as demonstrated by Sidney et al. (J. Immunol. 157:3480-3490, 1996).

Analoging at primary anchor residues of other motif and/or supermotif-bearing epitopes is performed in a like manner.

The analog peptides are then be confirmed for immunogenicity, typically in a cellular screening assay. Again, it is generally important to demonstrate that analog-specific CTLs are also able to recognize the wild-type peptide and, when possible, targets that endogenously express the epitope.

Analoging at Secondary Anchor Residues

Moreover, HLA supermotifs are of value in engineering highly cross-reactive peptides and/or peptides that bind HLA molecules with increased affinity by identifying particular residues at secondary anchor positions that are associated with such properties. For example, the binding capacity of a B7 supermotif-bearing peptide with an F residue at position 1 is analyzed. The peptide is then analoged to, for example, substitute L for F at position 1. The analoged peptide is evaluated for increased binding affinity, binding half life and/or increased cross-reactivity. Such a procedure identifies analoged peptides with enhanced properties.

Engineered analogs with sufficiently improved binding capacity or cross-reactivity can also be tested for immunogenicity in HLA-B7-transgenic mice, following for example, IFA immunization or lipopeptide immunization. Analoged peptides are additionally tested for the ability to stimulate a recall response using PBMC from patients with 158P3D2-expressing tumors.

Other Analoging Strategies

Another form of peptide analoging, unrelated to anchor positions, involves the substitution of a cysteine with α-amino butyric acid. Due to its chemical nature, cysteine has the propensity to form disulfide bridges and sufficiently alter the peptide structurally so as to reduce binding capacity. Substitution of α-amino butyric acid for cysteine not only alleviates this problem, but has been shown to improve binding and crossbinding capabilities in some instances (see, e.g., the review by Sette et al., In: Persistent Viral Infections, Eds. R. Ahmed and I. Chen, John Wiley & Sons, England, 1999).

Thus, by the use of single amino acid substitutions, the binding properties and/or cross-reactivity of peptide ligands for HLA supertype molecules can be modulated.

Example 16

Identification and Confirmation of 158P3D2-Derived Sequences with HLA-DR Binding Motifs Peptide epitopes bearing an HLA class II supermotif or motif are identified and confirmed as outlined below using methodology similar to that described for HLA Class I peptides.

Selection of HLA-DR-Supermotif-Bearing Epitopes.

To identify 158P3D2-derived, HLA class II HTL epitopes, a 158P3D2 antigen is analyzed for the presence of sequences bearing an HLA-DR-motif or supermotif. Specifically, 15-mer sequences are selected comprising a DR-supermotif, comprising a 9-mer core, and three-residue N- and C-terminal flanking regions (15 amino acids total).

Protocols for predicting peptide binding to DR molecules have been developed (Southwood et al., J. Immunol. 160:3363-3373, 1998). These protocols, specific for individual DR molecules, allow the scoring, and ranking, of 9-mer core regions. Each protocol not only scores peptide sequences for the presence of DR-supermotif primary anchors (i.e., at position 1 and position 6) within a 9-mer core, but additionally evaluates sequences for the presence of secondary anchors. Using allele-specific selection tables (see, e.g., Southwood et al., ibid.), it has been found that these protocols efficiently select peptide sequences with a high probability of binding a particular DR molecule. Additionally, it has been found that performing these protocols in tandem, specifically those for DR1, DR4w4, and DR7, can efficiently select DR cross-reactive peptides.

The 158P3D2-derived peptides identified above are tested for their binding capacity for various common HLA-DR molecules. All peptides are initially tested for binding to the DR molecules in the primary panel: DR1, DR4w4, and DR7. Peptides binding at least two of these three DR molecules are then tested for binding to DR2w2 β1, DR2w2 β2, DR6w19, and DR9 molecules in secondary assays. Finally, peptides binding at least two of the four secondary panel DR molecules, and thus cumulatively at least four of seven different DR molecules, are screened for binding to DR4w15, DR5w11, and DR8w2 molecules in tertiary assays. Peptides binding at least seven of the ten DR molecules comprising the primary, secondary, and tertiary screening assays are considered cross-reactive DR binders. 158P3D2-derived peptides found to bind common HLA-DR alleles are of particular interest.

Selection of DR3 Motif Peptides

Because HLA-DR3 is an allele that is prevalent in Caucasian, Black, and Hispanic populations, DR3 binding capacity is a relevant criterion in the selection of HTL epitopes. Thus, peptides shown to be candidates may also be assayed for their DR3 binding capacity. However, in view of the binding specificity of the DR3 motif, peptides binding only to DR3 can also be considered as candidates for inclusion in a vaccine formulation.

To efficiently identify peptides that bind DR3, target 158P3D2 antigens are analyzed for sequences carrying one of the two DR3-specific binding motifs reported by Geluk et al. (J. Immunol. 152:5742-5748, 1994). The corresponding peptides are then synthesized and confirmed as having the ability to bind DR3 with an affinity of 1 μM or better, i.e., less than 1 μM. Peptides are found that meet this binding criterion and qualify as HLA class II high affinity binders.

DR3 binding epitopes identified in this manner are included in vaccine compositions with DR supermotif-bearing peptide epitopes.

Similarly to the case of HLA class I motif-bearing peptides, the class II motif-bearing peptides are analoged to improve affinity or cross-reactivity. For example, aspartic acid at position 4 of the 9-mer core sequence is an optimal residue for DR3 binding, and substitution for that residue often improves DR 3 binding.

Example 17

Immunogenicity of 158P3D2-Derived HTL Epitopes

This example determines immunogenic DR supermotif- and DR3 motif-bearing epitopes among those identified using the methodology set forth herein.

Immunogenicity of HTL epitopes are confirmed in a manner analogous to the determination of immunogenicity of CTL epitopes, by assessing the ability to stimulate HTL responses and/or by using appropriate transgenic mouse models. Immunogenicity is determined by screening for: 1.) in vitro primary induction using normal PBMC or 2.) recall responses from patients who have 158P3D2-expressing tumors.

Example 18

Calculation of Phenotypic Frequencies of HLA-Supertypes in Various Ethnic Backgrounds to Determine Breadth of Population Coverage This example illustrates the assessment of the breadth of population coverage of a vaccine composition comprised of multiple epitopes comprising multiple supermotifs and/or motifs.

In order to analyze population coverage, gene frequencies of HLA alleles are determined. Gene frequencies for each HLA allele are calculated from antigen or allele frequencies utilizing the binomial distribution formulae gf=1−(SQRT(1−af)) (see, e.g., Sidney et al., Human Immunol. 45:79-93, 1996). To obtain overall phenotypic frequencies, cumulative gene frequencies are calculated, and the cumulative antigen frequencies derived by the use of the inverse formula [af=1−(1−Cgf)2].

Where frequency data is not available at the level of DNA typing, correspondence to the serologically defined antigen frequencies is assumed. To obtain total potential supertype population coverage no linkage disequilibrium is assumed, and only alleles confirmed to belong to each of the supertypes are included (minimal estimates). Estimates of total potential coverage achieved by inter-loci combinations are made by adding to the A coverage the proportion of the non-A covered population that could be expected to be covered by the B alleles considered (e.g., total=A+B*(1−A)). Confirmed members of the A3-like supertype are A3, A11, A31, A*3301, and A*6801. Although the A3-like supertype may also include A34, A66, and A*7401, these alleles were not included in overall frequency calculations. Likewise, confirmed members of the A2-like supertype family are A*0201, A*0202, A*0203, A*0204, A*0205, A*0206, A*0207, A*6802, and A*6901. Finally, the B7-like supertype-confirmed alleles are: B7, B*3501-03, B51, B*5301, B*5401, B*5501-2, B*5601, B*6701, and B*7801 (potentially also B*1401, B*3504-06, B*4201, and B*5602).

Population coverage achieved by combining the A2-, A3- and B7-supertypes is approximately 86% in five major ethnic groups. Coverage may be extended by including peptides bearing the A1 and A24 motifs. On average, A1 is present in 12% and A24 in 29% of the population across five different major ethnic groups (Caucasian, North American Black, Chinese, Japanese, and Hispanic). Together, these alleles are represented with an average frequency of 39% in these same ethnic populations. The total coverage across the major ethnicities when A1 and A24 are combined with the coverage of the A2-, A3- and B7-supertype alleles is >95%, see, e.g., Table IV (G). An analogous approach can be used to estimate population coverage achieved with combinations of class II motif-bearing epitopes.

Immunogenicity studies in humans (e.g., Bertoni et al., J. Clin. Invest. 100:503, 1997; Doolan et al., Immunity 7:97, 1997; and Threlkeld et al., J. Immunol. 159:1648, 1997) have shown that highly cross-reactive binding peptides are almost always recognized as epitopes. The use of highly cross-reactive binding peptides is an important selection criterion in identifying candidate epitopes for inclusion in a vaccine that is immunogenic in a diverse population.

With a sufficient number of epitopes (as disclosed herein and from the art), an average population coverage is predicted to be greater than 95% in each of five major ethnic populations. The game theory Monte Carlo simulation analysis, which is known in the art (see e.g., Osborne, M. J. and Rubinstein, A. "A course in game theory" MIT Press, 1994), can be used to estimate what percentage of the individuals in a population comprised of the Caucasian, North American Black, Japanese, Chinese, and Hispanic ethnic groups would recognize the vaccine epitopes described herein. A preferred percentage is 90%. A more preferred percentage is 95%.

Example 19

CTL Recognition of Endogenously Processed Antigens after Priming

This example confirms that CTL induced by native or analoged peptide epitopes identified and selected as described herein recognize endogenously synthesized, i.e., native antigens.

Effector cells isolated from transgenic mice that are immunized with peptide epitopes, for example HLA-A2 supermotif-bearing epitopes, are re-stimulated in vitro using peptide-coated stimulator cells. Six days later, effector cells are assayed for cytotoxicity and the cell lines that contain peptide-specific cytotoxic activity are further re-stimulated. An additional six days later, these cell lines are tested for cytotoxic activity on $^{51}$Cr labeled Jurkat-A2.1/K$^b$ target cells in the absence or presence of peptide, and also tested on $^{51}$Cr labeled target cells bearing the endogenously synthesized antigen, i.e. cells that are stably transfected with 158P3D2 expression vectors.

The results demonstrate that CTL lines obtained from animals primed with peptide epitope recognize endogenously synthesized 158P3D2 antigen. The choice of transgenic mouse model to be used for such an analysis depends upon the epitope(s) that are being evaluated. In addition to HLA-A*0201/K$^b$ transgenic mice, several other transgenic mouse models including mice with human A11, which may also be used to evaluate A3 epitopes, and B7 alleles have been characterized and others (e.g., transgenic mice for HLA-A1 and A24) are being developed. HLA-DR1 and HLA-DR3 mouse models have also been developed, which may be used to evaluate HTL epitopes.

Example 20

Activity of CTL-HTL Conjugated Epitopes in Transgenic Mice

This example illustrates the induction of CTLs and HTLs in transgenic mice, by use of a 158P3D2-derived CTL and HTL peptide vaccine compositions. The vaccine composition used herein comprise peptides to be administered to a patient with a 158P3D2-expressing tumor. The peptide composition can comprise multiple CTL and/or HTL epitopes. The epitopes are identified using methodology as described herein. This example also illustrates that enhanced immunogenicity can be achieved by inclusion of one or more HTL epitopes in a CTL vaccine composition; such a peptide composition can comprise an HTL epitope conjugated to a CTL epitope. The CTL epitope can be one that binds to multiple HLA family members at an affinity of 500 nM or less, or analogs of that epitope. The peptides may be lipidated, if desired.

Immunization procedures: Immunization of transgenic mice is performed as described (Alexander et al., *J. Immunol.* 159:4753-4761, 1997). For example, A2/K$^b$ mice, which are transgenic for the human HLA A2.1 allele and are used to confirm the immunogenicity of HLA-A*0201 motif- or HLA-A2 supermotif-bearing epitopes, and are primed subcutaneously (base of the tail) with a 0.1 ml of peptide in Incomplete Freund's Adjuvant, or if the peptide composition is a lipidated CTL/HTL conjugate, in DMSO/saline, or if the peptide composition is a polypeptide, in PBS or Incomplete Freund's Adjuvant. Seven days after priming, splenocytes obtained from these animals are restimulated with syngenic irradiated LPS-activated lymphoblasts coated with peptide.

Cell lines: Target cells for peptide-specific cytotoxicity assays are Jurkat cells transfected with the HLA-A2.1/K$^b$ chimeric gene (e.g., Vitiello et al., *J. Exp. Med.* 173:1007, 1991).

In vitro CTL activation: One week after priming, spleen cells (30×10$^6$ cells/flask) are co-cultured at 37° C. with syngeneic, irradiated (3000 rads), peptide coated lymphoblasts (10×10$^6$ cells/flask) in 10 ml of culture medium/T25 flask. After six days, effector cells are harvested and assayed for cytotoxic activity.

Assay for cytotoxic activity: Target cells (1.0 to 1.5×10$^6$) are incubated at 37° C. in the presence of 200 μl of $^{51}$Cr. After 60 minutes, cells are washed three times and resuspended in R10 medium. Peptide is added where required at a concentration of 1 μg/ml. For the assay, 10$^4$ $^{51}$Cr-labeled target cells are added to different concentrations of effector cells (final volume of 200 μl) in U-bottom 96-well plates. After a six hour incubation period at 37° C., a 0.1 ml aliquot of supernatant is removed from each well and radioactivity is determined in a Micromedic automatic gamma counter. The percent specific lysis is determined by the formula: percent specific release=100×(experimental release−spontaneous release)/(maximum release−spontaneous release). To facilitate comparison between separate CTL assays run under the same conditions, % $^{51}$Cr release data is expressed as lytic units/10$^6$ cells. One lytic unit is arbitrarily defined as the number of effector cells required to achieve 30% lysis of 10,000 target cells in a six hour $^{51}$Cr release assay. To obtain specific lytic units/10$^6$, the lytic units/10$^6$ obtained in the absence of peptide is subtracted from the lytic units/10$^6$ obtained in the presence of peptide. For example, if 30% $^{51}$Cr release is obtained at the effector (E): target (T) ratio of 50:1 (i.e., 5×10$^5$ effector cells for 10,000 targets) in the absence of peptide and 5:1 (i.e., 5×10$^4$ effector cells for 10,000 targets) in the presence of peptide, the specific lytic units would be: [(1/50,000)−(1/500,000)]×10$^6$=18 LU.

The results are analyzed to assess the magnitude of the CTL responses of animals injected with the immunogenic CTL/HTL conjugate vaccine preparation and are compared to the magnitude of the CTL response achieved using, for example, CTL epitopes as outlined above in the Example entitled "Confirmation of Immunogenicity." Analyses similar to this may be performed to conform the immunogenicity of peptide conjugates containing multiple CTL epitopes and/or multiple HTL epitopes. In accordance with these procedures, it is found that a CTL response is induced, and concomitantly that an HTL response is induced upon administration of such compositions.

Example 21

Selection of CTL and HTL Epitopes for Inclusion in a 158P3D2-Specific Vaccine This example illustrates a procedure for selecting peptide epitopes for vaccine compositions of the invention. The peptides in the composition can be in the form of a nucleic acid sequence, either single or one or more sequences (i.e., minigene) that encodes peptide(s), or can be single and/or polyepitopic peptides.

The following principles are utilized when selecting a plurality of epitopes for inclusion in a vaccine composition. Each of the following principles is balanced in order to make the selection.

Epitopes are selected which, upon administration, mimic immune responses that are correlated with 158P3D2 clearance. The number of epitopes used depends on observations of patients who spontaneously clear 158P3D2. For example, if it has been observed that patients who spontaneously clear 158P3D2-expressing cells generate an immune response to at least three (3) epitopes from 158P3D2 antigen, then at least three epitopes should be included for HLA class I. A similar rationale is used to determine HLA class II epitopes.

Epitopes are often selected that have a binding affinity of an $IC_{50}$ of 500 nM or less for an HLA class I molecule, or for class II, an $IC_{50}$ of 1000 nM or less; or HLA Class I peptides with high binding scores from the BIMAS web site, at URL bimas.dcrt.nih.gov/.

In order to achieve broad coverage of the vaccine throughout a diverse population, sufficient supermotif bearing peptides, or a sufficient array of allele-specific motif bearing peptides, are selected to give broad population coverage. In one embodiment, epitopes are selected to provide at least 80% population coverage. A Monte Carlo analysis, a statistical evaluation known in the art, can be employed to assess breadth, or redundancy, of population coverage.

When creating polyepitopic compositions, or a minigene that encodes same, it is typically desirable to generate the smallest peptide possible that encompasses the epitopes of interest. The principles employed are similar, if not the same, as those employed when selecting a peptide comprising nested epitopes. For example, a protein sequence for the vaccine composition is selected because it has maximal number of epitopes contained within the sequence, i.e., it has a high concentration of epitopes. Epitopes may be nested or overlapping (i.e., frame shifted relative to one another). For example, with overlapping epitopes, two 9-mer epitopes and one 10-mer epitope can be present in a 10 amino acid peptide. Each epitope can be exposed and bound by an HLA molecule upon administration of such a peptide. A multi-epitopic, peptide can be generated synthetically, recombinantly, or via cleavage from the native source. Alternatively, an analog can be made of this native sequence, whereby one or more of the epitopes comprise substitutions that alter the cross-reactivity and/or binding affinity properties of the polyepitopic peptide. Such a vaccine composition is administered for therapeutic or prophylactic purposes. This embodiment provides for the possibility that an as yet undiscovered aspect of immune system processing will apply to the native nested sequence and thereby facilitate the production of therapeutic or prophylactic immune response-inducing vaccine compositions. Additionally such an embodiment provides for the possibility of motif-bearing epitopes for an HLA makeup that is presently unknown. Furthermore, this embodiment (absent the creating of any analogs) directs the immune response to multiple peptide sequences that are actually present in 158P3D2, thus avoiding the need to evaluate any junctional epitopes. Lastly, the embodiment provides an economy of scale when producing nucleic acid vaccine compositions. Related to this embodiment, computer programs can be derived in accordance with principles in the art, which identify in a target sequence, the greatest number of epitopes per sequence length.

A vaccine composition comprised of selected peptides, when administered, is safe, efficacious, and elicits an immune response similar in magnitude to an immune response that controls or clears cells that bear or overexpress 158P3D2.

Example 22

Construction of "Minigene" Multi-Epitope DNA Plasmids

This example discusses the construction of a minigene expression plasmid. Minigene plasmids may, of course, contain various configurations of B cell, CTL and/or HTL epitopes or epitope analogs as described herein.

A minigene expression plasmid typically includes multiple CTL and HTL peptide epitopes. In the present example, HLA-A2, -A3, -B7 supermotif-bearing peptide epitopes and HLA-A1 and -A24 motif-bearing peptide epitopes are used in conjunction with DR supermotif-bearing epitopes and/or DR3 epitopes. HLA class I supermotif or motif-bearing peptide epitopes derived 158P3D2, are selected such that multiple supermotifs/motifs are represented to ensure broad population coverage. Similarly, HLA class II epitopes are selected from 158P3D2 to provide broad population coverage, i.e. both HLA DR-1-4-7 supermotif-bearing epitopes and HLA DR-3 motif-bearing epitopes are selected for inclusion in the minigene construct. The selected CTL and HTL epitopes are then incorporated into a minigene for expression in an expression vector.

Such a construct may additionally include sequences that direct the HTL epitopes to the endoplasmic reticulum. For example, the Ii protein may be fused to one or more HTL epitopes as described in the art, wherein the CLIP sequence of the Ii protein is removed and replaced with an HLA class II epitope sequence so that HLA class II epitope is directed to the endoplasmic reticulum, where the epitope binds to an HLA class II molecules.

This example illustrates the methods to be used for construction of a minigene-bearing expression plasmid. Other expression vectors that may be used for minigene compositions are available and known to those of skill in the art.

The minigene DNA plasmid of this example contains a consensus Kozak sequence and a consensus murine kappa Ig-light chain signal sequence followed by CTL and/or HTL epitopes selected in accordance with principles disclosed herein. The sequence encodes an open reading frame fused to the Myc and His antibody epitope tag coded for by the pcDNA 3.1 Myc-His vector.

Overlapping oligonucleotides that can, for example, average about 70 nucleotides in length with 15 nucleotide overlaps, are synthesized and HPLC-purified. The oligonucleotides encode the selected peptide epitopes as well as appropriate linker nucleotides, Kozak sequence, and signal sequence. The final multiepitope minigene is assembled by extending the overlapping oligonucleotides in three sets of reactions using PCR. A Perkin/Elmer 9600 PCR machine is used and a total of 30 cycles are performed using the following conditions: 95° C. for 15 sec, annealing temperature (5° below the lowest calculated Tm of each primer pair) for 30 sec, and 72° C. for 1 min.

For example, a minigene is prepared as follows. For a first PCR reaction, 5 μg of each of two oligonucleotides are annealed and extended: In an example using eight oligonucleotides, i.e., four pairs of primers, oligonucleotides 1+2, 3+4, 5+6, and 7+8 are combined in 100 μl reactions containing Pfu polymerase buffer (1×=10 mM KCL, 10 mM $(NH4)_2SO_4$, 20 mM Tris-chloride, pH 8.75, 2 mM $MgSO_4$, 0.1% Triton X-100, 100 μg/ml BSA), 0.25 mM each dNTP, and 2.5 U of Pfu polymerase. The full-length dimer products are gel-purified, and two reactions containing the product of 1+2 and 3+4, and the product of 5+6 and 7+8 are mixed, annealed, and extended for 10 cycles. Half of the two reactions are then mixed, and 5 cycles of annealing and extension carried out before flanking primers are added to amplify the full length product. The full-length product is gel-purified and cloned into pCR-blunt (Invitrogen) and individual clones are screened by sequencing.

Example 23

The Plasmid Construct and the Degree to which it Induces Immunogenicity

The degree to which a plasmid construct, for example a plasmid constructed in accordance with the previous Example, is able to induce immunogenicity is confirmed in vitro by determining epitope presentation by APC following transduction or transfection of the APC with an epitope-expressing nucleic acid construct. Such a study determines "antigenicity" and allows the use of human APC. The assay determines the ability of the epitope to be presented by the APC in a context that is recognized by a T cell by quantifying the density of epitope-HLA class I complexes on the cell surface. Quantitation can be performed by directly measuring the amount of peptide eluted from the APC (see, e.g., Sijts et al., *J. Immunol.* 156:683-692, 1996; Demotz et al., *Nature* 342:682-684, 1989); or the number of peptide-HLA class I complexes can be estimated by measuring the amount of lysis or lymphokine release induced by diseased or transfected target cells, and then determining the concentration of peptide necessary to obtain equivalent levels of lysis or lymphokine release (see, e.g., Kageyama et al., *J. Immunol.* 154:567-576, 1995).

Alternatively, immunogenicity is confirmed through in vivo injections into mice and subsequent in vitro assessment of CTL and HTL activity, which are analyzed using cytotoxicity and proliferation assays, respectively, as detailed e.g., in Alexander et al., *Immunity* 1:751-761, 1994.

For example, to confirm the capacity of a DNA minigene construct containing at least one HLA-A2 supermotif peptide to induce CTLs in vivo, HLA-A2.1/$K^b$ transgenic mice, for example, are immunized intramuscularly with 100 µg of naked cDNA. As a means of comparing the level of CTLs induced by cDNA immunization, a control group of animals is also immunized with an actual peptide composition that comprises multiple epitopes synthesized as a single polypeptide as they would be encoded by the minigene.

Splenocytes from immunized animals are stimulated twice with each of the respective compositions (peptide epitopes encoded in the minigene or the polyepitopic peptide), then assayed for peptide-specific cytotoxic activity in a $^{51}$Cr release assay. The results indicate the magnitude of the CTL response directed against the A2-restricted epitope, thus indicating the in vivo immunogenicity of the minigene vaccine and polyepitopic vaccine.

It is, therefore, found that the minigene elicits immune responses directed toward the HLA-A2 supermotif peptide epitopes as does the polyepitopic peptide vaccine. A similar analysis is also performed using other HLA-A3 and HLA-B7 transgenic mouse models to assess CTL induction by HLA-A3 and HLA-B7 motif or supermotif epitopes, whereby it is also found that the minigene elicits appropriate immune responses directed toward the provided epitopes.

To confirm the capacity of a class II epitope-encoding minigene to induce HTLs in vivo, DR transgenic mice, or for those epitopes that cross react with the appropriate mouse MHC molecule, I-$A^b$-restricted mice, for example, are immunized intramuscularly with 100 µg of plasmid DNA. As a means of comparing the level of HTLs induced by DNA immunization, a group of control animals is also immunized with an actual peptide composition emulsified in complete Freund's adjuvant. CD4+ T cells, i.e. HTLs, are purified from splenocytes of immunized animals and stimulated with each of the respective compositions (peptides encoded in the minigene). The HTL response is measured using a $^3$H-thymidine incorporation proliferation assay, (see, e.g., Alexander et al. *Immunity* 1:751-761, 1994). The results indicate the magnitude of the HTL response, thus demonstrating the in vivo immunogenicity of the minigene.

DNA minigenes, constructed as described in the previous Example, can also be confirmed as a vaccine in combination with a boosting agent using a prime boost protocol. The boosting agent can consist of recombinant protein (e.g., Barnett et al., *Aids Res. and Human Retroviruses* 14, Supplement 3:S299-S309, 1998) or recombinant vaccinia, for example, expressing a minigene or DNA encoding the complete protein of interest (see, e.g., Hanke et al., *Vaccine* 16:439-445, 1998; Sedegah et al., *Proc. Natl. Acad. Sci USA* 95:7648-53, 1998; Hanke and McMichael, *Immunol. Letters* 66:177-181, 1999; and Robinson et al., *Nature Med.* 5:526-34, 1999).

For example, the efficacy of the DNA minigene used in a prime boost protocol is initially evaluated in transgenic mice. In this example, A2.1/$K^b$ transgenic mice are immunized IM with 100 µg of a DNA minigene encoding the immunogenic peptides including at least one HLA-A2 supermotif-bearing peptide. After an incubation period (ranging from 3-9 weeks), the mice are boosted IP with $10^7$ pfu/mouse of a recombinant vaccinia virus expressing the same sequence encoded by the DNA minigene. Control mice are immunized with 100 µg of DNA or recombinant vaccinia without the minigene sequence, or with DNA encoding the minigene, but without the vaccinia boost. After an additional incubation period of two weeks, splenocytes from the mice are immediately assayed for peptide-specific activity in an ELISPOT assay. Additionally, splenocytes are stimulated in vitro with the A2-restricted peptide epitopes encoded in the minigene and recombinant vaccinia, then assayed for peptide-specific activity in an alpha, beta and/or gamma IFN ELISA.

It is found that the minigene utilized in a prime-boost protocol elicits greater immune responses toward the HLA-A2 supermotif peptides than with DNA alone. Such an analysis can also be performed using HLA-A11 or HLA-B7 transgenic mouse models to assess CTL induction by HLA-A3 or HLA-B7 motif or supermotif epitopes. The use of prime boost protocols in humans is described below in the Example entitled "Induction of CTL Responses Using a Prime Boost Protocol."

Example 24

Peptide Compositions for Prophylactic Uses

Vaccine compositions of the present invention can be used to prevent 158P3D2 expression in persons who are at risk for tumors that bear this antigen. For example, a polyepitopic peptide epitope composition (or a nucleic acid comprising the same) containing multiple CTL and HTL epitopes such as those selected in the above Examples, which are also selected to target greater than 80% of the population, is administered to individuals at risk for a 158P3D2-associated tumor.

For example, a peptide-based composition is provided as a single polypeptide that encompasses multiple epitopes. The vaccine is typically administered in a physiological solution that comprises an adjuvant, such as Incomplete Freunds Adjuvant. The dose of peptide for the initial immunization is from about 1 to about 50,000 µg, generally 100-5,000 µg, for a 70 kg patient. The initial administration of vaccine is followed by booster dosages at 4 weeks followed by evaluation of the magnitude of the immune response in the patient, by techniques that determine the presence of epitope-specific CTL populations in a PBMC sample. Additional booster doses are administered as required. The composition is found to be both safe and efficacious as a prophylaxis against 158P3D2-associated disease.

Alternatively, a composition typically comprising transfecting agents is used for the administration of a nucleic acid-based vaccine in accordance with methodologies known in the art and disclosed herein.

Example 25

Polyepitopic Vaccine Compositions Derived from Native 158P3D2 Sequences

A native 158P3D2 polyprotein sequence is analyzed, preferably using computer algorithms defined for each class I and/or class II supermotif or motif, to identify "relatively short" regions of the polyprotein that comprise multiple epitopes. The "relatively short" regions are preferably less in length than an entire native antigen. This relatively short sequence that contains multiple distinct or overlapping, "nested" epitopes can be used to generate a minigene construct. The construct is engineered to express the peptide, which corresponds to the native protein sequence. The "relatively short" peptide is generally less than 250 amino acids in length, often less than 100 amino acids in length, preferably less than 75 amino acids in length, and more preferably less than 50 amino acids in length. The protein sequence of the vaccine composition is selected because it has maximal number of epitopes contained within the sequence, i.e., it has a high concentration of epitopes. As noted herein, epitope motifs may be nested or overlapping (i.e., frame shifted relative to one another). For example, with overlapping epitopes, two 9-mer epitopes and one 10-mer epitope can be present in a 10 amino acid peptide. Such a vaccine composition is administered for therapeutic or prophylactic purposes.

The vaccine composition will include, for example, multiple CTL epitopes from 158P3D2 antigen and at least one HTL epitope. This polyepitopic native sequence is administered either as a peptide or as a nucleic acid sequence which encodes the peptide. Alternatively, an analog can be made of this native sequence, whereby one or more of the epitopes comprise substitutions that alter the cross-reactivity and/or binding affinity properties of the polyepitopic peptide.

The embodiment of this example provides for the possibility that an as yet undiscovered aspect of immune system processing will apply to the native nested sequence and thereby facilitate the production of therapeutic or prophylactic immune response-inducing vaccine compositions. Additionally, such an embodiment provides for the possibility of motif-bearing epitopes for an HLA makeup(s) that is presently unknown. Furthermore, this embodiment (excluding an analoged embodiment) directs the immune response to multiple peptide sequences that are actually present in native 158P3D2, thus avoiding the need to evaluate any junctional epitopes. Lastly, the embodiment provides an economy of scale when producing peptide or nucleic acid vaccine compositions.

Related to this embodiment, computer programs are available in the art which can be used to identify in a target sequence, the greatest number of epitopes per sequence length.

Example 26

Polyepitopic Vaccine Compositions from Multiple Antigens

The 158P3D2 peptide epitopes of the present invention are used in conjunction with epitopes from other target tumor-associated antigens, to create a vaccine composition that is useful for the prevention or treatment of cancer that expresses 158P3D2 and such other antigens. For example, a vaccine composition can be provided as a single polypeptide that incorporates multiple epitopes from 158P3D2 as well as tumor-associated antigens that are often expressed with a target cancer associated with 158P3D2 expression, or can be administered as a composition comprising a cocktail of one or more discrete epitopes. Alternatively, the vaccine can be administered as a minigene construct or as dendritic cells which have been loaded with the peptide epitopes in vitro.

Example 27

Use of Peptides to Evaluate an Immune Response

Peptides of the invention may be used to analyze an immune response for the presence of specific antibodies, CTL or HTL directed to 158P3D2. Such an analysis can be performed in a manner described by Ogg et al., *Science* 279: 2103-2106, 1998. In this Example, peptides in accordance with the invention are used as a reagent for diagnostic or prognostic purposes, not as an immunogen.

In this example highly sensitive human leukocyte antigen tetrameric complexes ("tetramers") are used for a cross-sectional analysis of, for example, 158P3D2 HLA-A*0201-specific CTL frequencies from HLA A*0201-positive individuals at different stages of disease or following immunization comprising a 158P3D2 peptide containing an A*0201 motif. Tetrameric complexes are synthesized as described (Musey et al., *N. Engl. J. Med.* 337:1267, 1997). Briefly, purified HLA heavy chain (A*0201 in this example) and β2-microglobulin are synthesized by means of a prokaryotic expression system. The heavy chain is modified by deletion of the transmembrane-cytosolic tail and COOH-terminal addition of a sequence containing a BirA enzymatic biotinylation site. The heavy chain, β2-microglobulin, and peptide are refolded by dilution. The 45-kD refolded product is isolated by fast protein liquid chromatography and then biotinylated by BirA in the presence of biotin (Sigma, St. Louis, Mo.), adenosine 5' triphosphate and magnesium. Streptavidin-phycoerythrin conjugate is added in a 1:4 molar ratio, and the tetrameric product is concentrated to 1 mg/ml. The resulting product is referred to as tetramer-phycoerythrin.

For the analysis of patient blood samples, approximately one million PBMCs are centrifuged at 300 g for 5 minutes and resuspended in 50 μl of cold phosphate-buffered saline. Tri-color analysis is performed with the tetramer-phycoerythrin, along with anti-CD8-Tricolor, and anti-CD38. The PBMCs are incubated with tetramer and antibodies on ice for 30 to 60 min and then washed twice before formaldehyde fixation. Gates are applied to contain >99.98% of control samples. Controls for the tetramers include both A*0201-negative individuals and A*0201-positive non-diseased donors. The percentage of cells stained with the tetramer is then determined by flow cytometry. The results indicate the number of cells in the PBMC sample that contain epitope-restricted CTLs, thereby readily indicating the extent of immune response to the 158P3D2 epitope, and thus the status of exposure to 158P3D2, or exposure to a vaccine that elicits a protective or therapeutic response.

Example 28

Use of Peptide Epitopes to Evaluate Recall Responses

The peptide epitopes of the invention are used as reagents to evaluate T cell responses, such as acute or recall responses, in patients. Such an analysis may be performed on patients who have recovered from 158P3D2-associated disease or who have been vaccinated with a 158P3D2 vaccine.

For example, the class I restricted CTL response of persons who have been vaccinated may be analyzed. The vaccine may be any 158P3D2 vaccine. PBMC are collected from vaccinated individuals and HLA typed. Appropriate peptide epitopes of the invention that, optimally, bear supermotifs to provide cross-reactivity with multiple HLA supertype family members, are then used for analysis of samples derived from individuals who bear that HLA type.

PBMC from vaccinated individuals are separated on Ficoll-Histopaque density gradients (Sigma Chemical Co., St. Louis, Mo.), washed three times in HBSS (GIBCO Laboratories), resuspended in RPMI-1640 (GIBCO Laboratories) supplemented with L-glutamine (2 mM), penicillin (50 U/ml), streptomycin (50 µg/ml), and Hepes (10 mM) containing 10% heat-inactivated human AB serum (complete RPMI) and plated using microculture formats. A synthetic peptide comprising an epitope of the invention is added at 10 µg/ml to each well and HBV core 128-140 epitope is added at 1 µg/ml to each well as a source of T cell help during the first week of stimulation.

In the microculture format, $4 \times 10^5$ PBMC are stimulated with peptide in 8 replicate cultures in 96-well round bottom plate in 100 µl/well of complete RPMI. On days 3 and 10, 100 µl of complete RPMI and 20 U/ml final concentration of rIL-2 are added to each well. On day 7 the cultures are transferred into a 96-well flat-bottom plate and restimulated with peptide, rIL-2 and $10^5$ irradiated (3,000 rad) autologous feeder cells. The cultures are tested for cytotoxic activity on day 14. A positive CTL response requires two or more of the eight replicate cultures to display greater than 10% specific $^{51}$Cr release, based on comparison with non-diseased control subjects as previously described (Rehermann, et al., *Nature Med.* 2:1104, 1108, 1996; Rehermann et al., *J. Clin. Invest.* 97:1655-1665, 1996; and Rehermann et al. *J. Clin. Invest.* 98:1432-1440, 1996).

Target cell lines are autologous and allogeneic EBV-transformed B-LCL that are either purchased from the American Society for Histocompatibility and Immunogenetics (ASHI, Boston, Mass.) or established from the pool of patients as described (Guilhot, et al. *J. Virol.* 66:2670-2678, 1992).

Cytotoxicity assays are performed in the following manner. Target cells consist of either allogeneic HLA-matched or autologous EBV-transformed B lymphoblastoid cell line that are incubated overnight with the synthetic peptide epitope of the invention at 10 µM, and labeled with 100 µCi of $^{51}$Cr (Amersham Corp., Arlington Heights, Ill.) for 1 hour after which they are washed four times with HBSS.

Cytolytic activity is determined in a standard 4-h, split well $^{51}$Cr release assay using U-bottomed 96 well plates containing 3,000 targets/well. Stimulated PBMC are tested at effector/target (E/T) ratios of 20-50:1 on day 14. Percent cytotoxicity is determined from the formula: 100×[(experimental release−spontaneous release)/maximum release−spontaneous release)]. Maximum release is determined by lysis of targets by detergent (2% Triton X-100; Sigma Chemical Co., St. Louis, Mo.). Spontaneous release is <25% of maximum release for all experiments.

The results of such an analysis indicate the extent to which HLA-restricted CTL populations have been stimulated by previous exposure to 158P3D2 or a 158P3D2 vaccine.

Similarly, Class II restricted HTL responses may also be analyzed. Purified PBMC are cultured in a 96-well flat bottom plate at a density of $1.5 \times 10^5$ cells/well and are stimulated with 10 µg/ml synthetic peptide of the invention, whole 158P3D2 antigen, or PHA. Cells are routinely plated in replicates of 4-6 wells for each condition. After seven days of culture, the medium is removed and replaced with fresh medium containing 10 U/ml IL-2. Two days later, 1 µCi $^3$H-thymidine is added to each well and incubation is continued for an additional 18 hours. Cellular DNA is then harvested on glass fiber mats and analyzed for $^3$H-thymidine incorporation. Antigen-specific T cell proliferation is calculated as the ratio of $^3$H-thymidine incorporation in the presence of antigen divided by the $^3$H-thymidine incorporation in the absence of antigen.

Example 29

Induction of Specific CTL Response in Humans

A human clinical trial for an immunogenic composition comprising CTL and HTL epitopes of the invention is set up as an IND Phase I, dose escalation study and carried out as a randomized, double-blind, placebo-controlled trial. Such a trial is designed, for example, as follows:

A total of about 27 individuals are enrolled and divided into 3 groups:

Group I: 3 subjects are injected with placebo and 6 subjects are injected with 5 µg of peptide composition;

Group II: 3 subjects are injected with placebo and 6 subjects are injected with 50 µg peptide composition;

Group III: 3 subjects are injected with placebo and 6 subjects are injected with 500 µg of peptide composition.

After 4 weeks following the first injection, all subjects receive a booster inoculation at the same dosage.

The endpoints measured in this study relate to the safety and tolerability of the peptide composition as well as its immunogenicity. Cellular immune responses to the peptide composition are an index of the intrinsic activity of this the peptide composition, and can therefore be viewed as a measure of biological efficacy. The following summarize the clinical and laboratory data that relate to safety and efficacy endpoints.

Safety: The incidence of adverse events is monitored in the placebo and drug treatment group and assessed in terms of degree and reversibility.

Evaluation of Vaccine Efficacy: For evaluation of vaccine efficacy, subjects are bled before and after injection. Peripheral blood mononuclear cells are isolated from fresh heparinized blood by Ficoll-Hypaque density gradient centrifugation, aliquoted in freezing media and stored frozen. Samples are assayed for CTL and HTL activity.

The vaccine is found to be both safe and efficacious.

Example 30

Phase II Trials in Patients Expressing 158P3D2

Phase II trials are performed to study the effect of administering the CTL-HTL peptide compositions to patients having cancer that expresses 158P3D2. The main objectives of the trial are to determine an effective dose and regimen for inducing CTLs in cancer patients that express 158P3D2, to establish the safety of inducing a CTL and HTL response in these patients, and to see to what extent activation of CTLs improves the clinical picture of these patients, as manifested, e.g., by the reduction and/or shrinking of lesions. Such a study is designed, for example, as follows:

The studies are performed in multiple centers. The trial design is an open-label, uncontrolled, dose escalation protocol wherein the peptide composition is administered as a single dose followed six weeks later by a single booster shot of the same dose. The dosages are 50, 500 and 5,000 micrograms per injection. Drug-associated adverse effects (severity and reversibility) are recorded.

There are three patient groupings. The first group is injected with 50 micrograms of the peptide composition and the second and third groups with 500 and 5,000 micrograms of peptide composition, respectively. The patients within each group range in age from 21-65 and represent diverse ethnic backgrounds. All of them have a tumor that expresses 158P3D2.

Clinical manifestations or antigen-specific T-cell responses are monitored to assess the effects of administering the peptide compositions. The vaccine composition is found to be both safe and efficacious in the treatment of 158P3D2-associated disease.

Example 31

Induction of CTL Responses Using a Prime Boost Protocol

A prime boost protocol similar in its underlying principle to that used to confirm the efficacy of a DNA vaccine in transgenic mice, such as described above in the Example entitled "The Plasmid Construct and the Degree to Which It Induces Immunogenicity," can also be used for the administration of the vaccine to humans. Such a vaccine regimen can include an initial administration of, for example, naked DNA followed by a boost using recombinant virus encoding the vaccine, or recombinant protein/polypeptide or a peptide mixture administered in an adjuvant.

For example, the initial immunization may be performed using an expression vector, such as that constructed in the Example entitled "Construction of "Minigene" Multi-Epitope DNA Plasmids" in the form of naked nucleic acid administered IM (or SC or ID) in the amounts of 0.5-5 mg at multiple sites. The nucleic acid (0.1 to 1000 µg) can also be administered using a gene gun. Following an incubation period of 3-4 weeks, a booster dose is then administered. The booster can be recombinant fowlpox virus administered at a dose of $5 \times 10^7$ to $5 \times 10^9$ pfu. An alternative recombinant virus, such as an MVA, canarypox, adenovirus, or adeno-associated virus, can also be used for the booster, or the polyepitopic protein or a mixture of the peptides can be administered. For evaluation of vaccine efficacy, patient blood samples are obtained before immunization as well as at intervals following administration of the initial vaccine and booster doses of the vaccine. Peripheral blood mononuclear cells are isolated from fresh heparinized blood by Ficoll-Hypaque density gradient centrifugation, aliquoted in freezing media and stored frozen. Samples are assayed for CTL and HTL activity.

Analysis of the results indicates that a magnitude of response sufficient to achieve a therapeutic or protective immunity against 158P3D2 is generated.

Example 32

Administration of Vaccine Compositions Using Dendritic Cells (DC)

Vaccines comprising peptide epitopes of the invention can be administered using APCs, or "professional" APCs such as DC. In this example, peptide-pulsed DC are administered to a patient to stimulate a CTL response in vivo. In this method, dendritic cells are isolated, expanded, and pulsed with a vaccine comprising peptide CTL and HTL epitopes of the invention. The dendritic cells are infused back into the patient to elicit CTL and HTL responses in vivo. The induced CTL and HTL then destroy or facilitate destruction, respectively, of the target cells that bear the 158P3D2 protein from which the epitopes in the vaccine are derived.

For example, a cocktail of epitope-comprising peptides is administered ex vivo to PBMC, or isolated DC therefrom. A pharmaceutical to facilitate harvesting of DC can be used, such as Progenipoietin™ (Monsanto, St. Louis, Mo.) or GM-CSF/IL-4. After pulsing the DC with peptides, and prior to reinfusion into patients, the DC are washed to remove unbound peptides.

As appreciated clinically, and readily determined by one of skill based on clinical outcomes, the number of DC reinfused into the patient can vary (see, e.g., *Nature Med.* 4:328, 1998; *Nature Med.* 2:52, 1996 and *Prostate* 32:272, 1997). Although $2\text{-}50 \times 10^6$ DC per patient are typically administered, larger number of DC, such as $10^7$ or $10^8$ can also be provided. Such cell populations typically contain between 50-90% DC.

In some embodiments, peptide-loaded PBMC are injected into patients without purification of the DC. For example, PBMC generated after treatment with an agent such as Progenipoietin™ are injected into patients without purification of the DC. The total number of PBMC that are administered often ranges from $10^8$ to $10^{10}$. Generally, the cell doses injected into patients is based on the percentage of DC in the blood of each patient, as determined, for example, by immunofluorescence analysis with specific anti-DC antibodies. Thus, for example, if Progenipoietin™ mobilizes 2% DC in the peripheral blood of a given patient, and that patient is to receive $5 \times 10^6$ DC, then the patient will be injected with a total of $2.5 \times 10^8$ peptide-loaded PBMC. The percent DC mobilized by an agent such as Progenipoietin™ is typically estimated to be between 2-10%, but can vary as appreciated by one of skill in the art.

Ex Vivo Activation of CTL/HTL Responses

Alternatively, ex vivo CTL or HTL responses to 158P3D2 antigens can be induced by incubating, in tissue culture, the patient's, or genetically compatible, CTL or HTL precursor cells together with a source of APC, such as DC, and immunogenic peptides. After an appropriate incubation time (typically about 7-28 days), in which the precursor cells are activated and expanded into effector cells, the cells are infused into the patient, where they will destroy (CTL) or facilitate destruction (HTL) of their specific target cells, i.e., tumor cells.

Example 33

An Alternative Method of Identifying and Confirming Motif-Bearing Peptides

Another method of identifying and confirming motif-bearing peptides is to elute them from cells bearing defined MHC molecules. For example, EBV transformed B cell lines used for tissue typing have been extensively characterized to determine which HLA molecules they express. In certain cases these cells express only a single type of HLA molecule. These cells can be transfected with nucleic acids that express the antigen of interest, e.g. 158P3D2. Peptides produced by endogenous antigen processing of peptides produced as a result of transfection will then bind to HLA molecules within the cell and be transported and displayed on the cell's surface. Peptides are then eluted from the HLA molecules by exposure to mild acid conditions and their amino acid sequence determined, e.g., by mass spectral analysis (e.g., Kubo et al., *J.*

*Immunol.* 152:3913, 1994). Because the majority of peptides that bind a particular HLA molecule are motif-bearing, this is an alternative modality for obtaining the motif-bearing peptides correlated with the particular HLA molecule expressed on the cell.

Alternatively, cell lines that do not express endogenous HLA molecules can be transfected with an expression construct encoding a single HLA allele. These cells can then be used as described, i.e., they can then be transfected with nucleic acids that encode 158P3D2 to isolate peptides corresponding to 158P3D2 that have been presented on the cell surface. Peptides obtained from such an analysis will bear motif(s) that correspond to binding to the single HLA allele that is expressed in the cell.

As appreciated by one in the art, one can perform a similar analysis on a cell bearing more than one HLA allele and subsequently determine peptides specific for each HLA allele expressed. Moreover, one of skill would also recognize that means other than transfection, such as loading with a protein antigen, can be used to provide a source of antigen to the cell.

Example 34

Complementary Polynucleotides

Sequences complementary to the 158P3D2-encoding sequences or any parts thereof, are used to detect, decrease, or inhibit expression of naturally occurring 158P3D2. Although use of oligonucleotides comprising from about 15 to 30 base pairs is described, essentially the same procedure is used with smaller or with larger sequence fragments. Appropriate oligonucleotides are designed using, e.g., OLIGO 4.06 software (National Biosciences) and the coding sequence of 158P3D2. To inhibit transcription, a complementary oligonucleotide is designed from the most unique 5' sequence and used to prevent promoter binding to the coding sequence. To inhibit translation, a complementary oligonucleotide is designed to prevent ribosomal binding to a 158P3D2-encoding transcript.

Example 35

Purification of Naturally-Occurring or Recombinant 158P3D2 Using 158P3D2-Specific Antibodies Naturally occurring or recombinant 158P3D2 is substantially purified by immunoaffinity chromatography using antibodies specific for 158P3D2. An immunoaffinity column is constructed by covalently coupling anti-158P3D2 antibody to an activated chromatographic resin, such as CNBr-activated SEPHAROSE (Amersham Pharmacia Biotech). After the coupling, the resin is blocked and washed according to the manufacturer's instructions.

Media containing 158P3D2 are passed over the immunoaffinity column, and the column is washed under conditions that allow the preferential absorbance of 158P3D2 (e.g., high ionic strength buffers in the presence of detergent). The column is eluted under conditions that disrupt antibody/158P3D2 binding (e.g., a buffer of pH 2 to pH 3, or a high concentration of a chaotrope, such as urea or thiocyanate ion), and GCR.P is collected.

Example 36

Identification of Molecules which Interact with 158P3D2

158P3D2, or biologically active fragments thereof, are labeled with 121 1 Bolton-Hunter reagent. (See, e.g., Bolton et al. (1973) Biochem. J. 133:529.) Candidate molecules previously arrayed in the wells of a multi-well plate are incubated with the labeled 158P3D2, washed, and any wells with labeled 158P3D2 complex are assayed. Data obtained using different concentrations of 158P3D2 are used to calculate values for the number, affinity, and association of 158P3D2 with the candidate molecules.

Example 37

In Vivo Assay for 158P3D2 Tumor Growth Promotion

In Vivo Assay of 3T3 Cell Growth by Recombinant Expression of 158P3D2.

To address the determination of 158P3D2 to accelerate the growth of non-tumorigenic cells in an in vivo mouse model, non-transformed 3T3 cells are prepared by infection with either a virus containing an empty vector control (Neo gene alone) or with a vector containing the 158P3D2 full-length gene. 3T3 cells are selected for survival in G-418, and expression of 158P3D2 confirmed by Northern blot analysis. To assess the growth of these cells, $1 \times 10^6$ 158P3D2 expressing 3T3 cells or $1 \times 10^6$ Neo control are mixed with Matrigel®, then injected intratibially or subcutaneously in SCID mice and allowed to grow for 30 days. The growth of these cells is assessed on day 30 by visual inspection and by necropsy. The 158P3D2 expressing 3T3 cells show a potent effect in comparison to the 3T3-Neo cells, indicating that the 158P3D2 protein enhanced the growth of the cells in Matrigel®. 158P3D2 promotes the growth of non-tumorigenic cells and provides a growth advantage in vivo that mimics the role of this protein in human malignancies.

Example 38

158P3D2 Monoclonal Antibody-Mediated Inhibition of Bladder, Lung Colon and Breast and Other Tumors In Vivo The significant expression of 158P3D2 in cancer tissues, together with its restrictive expression in normal tissues makes 158P3D2 a good target for antibody therapy. Similarly, 158P3D2 is a target for T cell-based immunotherapy. Thus, the therapeutic efficacy of anti-158P3D2 MAbs in human bladder cancer xenograft mouse models is evaluated by using recombinant cell lines such as J82-158P3D2 (see, e.g., Kaighn, M. E., et al., Invest Urol, 1979. 17(1): p. 16-23), as well as human bladder xenograft models (SCaBER).

Antibody efficacy on tumor growth and metastasis formation is studied, e.g., in a mouse orthotopic bladder cancer xenograft model. The antibodies can be unconjugated, as discussed in this Example, or can be conjugated to a therapeutic modality (see below), as appreciated in the art. Anti-158P3D2 MAbs inhibit formation of bladder xenografts. Anti-158P3D2 MAbs retard the growth of established orthotopic tumors and prolong survival of tumor-bearing mice. MAb effects on tumor growth in mouse models support the utility of anti-158P3D2 MAbs in the treatment of local and advanced stages of bladder cancer (see, e.g., Saffran, D., 2001, et al., PNAS 10:1073-1078).

Administration of the anti-158P3D2 MAbs leads to retardation of established orthotopic tumor growth and inhibition of metastasis to distant sites, resulting in a significant prolongation in the survival of tumor-bearing mice. Therefore, 158P3D2 is an attractive target for immunotherapy, and anti-158P3D2 MAbs have therapeutic potential for the treatment of local and metastatic cancer. This example demonstrates that unconjugated 158P3D2 monoclonal antibodies are effective to inhibit the growth of human bladder tumor xenografts grown in SCID mice; accordingly, a combination of such efficacious MAbs is also effective.

MAb-Toxin Conjugates:

Another embodiment of MAb therapy is through the use of toxin conjugation of MAbs for targeted delivery of cytotoxic agents to cells expressing the protein target. Major advances have been made in the clinical application of MAb toxin conjugates with the development of Mylotarg for acute myeloid leukemia (Bross, P. F., et al., 2001, Clin. Cancer Res. 7:1490-1496). Mylotarg is a humanized MAb directed to CD33 which is conjugated to a highly potent DNA-alkylating agent (calichemicin) via an acid labile hydrazone bond (Hamann, P. R., et al., 2002, Bioconjug. Chem. 13:40-46; ibid., 13:47-58). Additional toxins for MAb conjugation in development include maytansinoid, doxorubicin, taxoids and the potent synthetic dolastatin 10 analogs auristatin E and monomethylauristatin E (Doronina, S. O., et al., 2003, Nature Biotech. 21:778-784; Ross, S., et al., 2002, Cancer Res. 62:2546-2553; Francisco, J. A., et el., 2003, Blood 102: 1458-1465; Mao, W., et al., 2004, Cancer Res. 64:781-788). Such applications have potential to deliver a cytotoxic agent to cells expressing the protein target of the MAb. Internalization of the target protein upon MAb binding is important for toxin delivery, and the mechanism spares the non-targeted tissues from the potentially harmful effects of the cytotoxic agent.

158P3D2 MAbs conjugated to toxins are used to induce cell killing in vitro using established protocols for cytotoxicity assays and clonogenic assays (Doronina, S. O., et al., 2003, Nature Biotech. 21:778-784; Mao, W., et al., 2004, Cancer Res. 64:781-788). Toxin conjugated anti-158P3D2 MAbs induce cytotoxicity of cells expressing endogenous 158P3D2 (SCaBER cells) and recombinant 158P3D2 (PC3-158P3D2, 3T3-158P3D2, Rat-1-158P3D2 and B300.19-158P3D2). This methodology allows confirmation that the toxin conjugated MAb is functional against cells expressing the 158P3D2 protein on their surface versus those that do not express the target.

The MAb toxin conjugates are tested for their ability to inhibit tumor growth in vivo. Antibody efficacy on tumor growth and metastasis formation is studied, e.g., in a mouse orthotopic bladder cancer xenograft model, a mouse lung cancer xenograft model, or mouse colon or breast cancer xenograft model. Administration of the anti-158P3D2 MAbs led to retardation of established orthotopic tumor growth and inhibition of metastasis to distant sites, resulting in a significant prolongation in the survival of tumor-bearing mice. These studies indicate that 158P3D2 is an attractive target for immunotherapy and demonstrate the therapeutic potential of toxin-conjugated anti-158P3D2 MAbs for the treatment of local and metastatic cancer. This example demonstrates that toxin-conjugated 158P3D2 monoclonal antibodies are effective to inhibit the growth of human bladder, lung, breast and colon tumor xenografts grown in SCID mice; accordingly, a combination of such efficacious MAbs is also effective. The methodology allows the targeted delivery of a cytotoxin using a plasma stable linker in a MAb-toxin conjugate. Such a mechanism of action reduces the potential harmful effects of the toxin on non-targeted tissues.

Tumor Inhibition Using Multiple Unconjugated or Toxin-Conjugated 158P3D2 MAbs

Materials and Methods

158P3D2 Monoclonal Antibodies:

Monoclonal antibodies were raised against 158P3D2 as described in the Example entitled "Generation of 158P3D2 Monoclonal Antibodies (MAbs)." The antibodies are characterized by ELISA, Western blot, FACS, and immunoprecipitation for their capacity to bind 158P3D2. Epitope mapping data for the anti-158P3D2 MAbs, as determined by ELISA and Western analysis, recognize epitopes on the 158P3D2 protein. Immunohistochemical analysis of bladder cancer tissues and cells with these antibodies is performed.

The monoclonal antibodies are purified from ascites or hybridoma tissue culture supernatants by Protein-G Sepharose chromatography, dialyzed against PBS, filter sterilized, and stored at −20° C. Protein determinations are performed by a Bradford assay (Bio-Rad, Hercules, Calif.). A therapeutic monoclonal antibody or a cocktail comprising a mixture of individual monoclonal antibodies is prepared and used for the treatment of mice receiving subcutaneous or orthotopic injections of SCaBER or J82-158P3D2 tumor xenografts.

The MAbs to 158P3D2 are conjugated to various different toxins (listed above) using any of a variety of methods described elsewhere in the art (Hamann, P. R., et al., 2002, Bioconjug. Chem. 13:40-46; ibid., 13:47-58; Doronina, S. O., et al., 2003, Nature Biotech. 21:778-784; Ojima, I., et al. 2002, J. Med. Chem. 45:5620-5623; Dubowchik, G. M., et al., 2002, Bioconjug. Chem. 13:855-869; King, H. D., 2002, J. Med. Chem 45:4336-4343; Ross, S., et al., 2002, Cancer Res. 62:2546-2553; Francisco, J. A., et el., 2003, Blood 102: 1458-1465 Mao, W., et al., 2004, Cancer Res. 64:781-788).

Cell Lines

The bladder carcinoma cell lines, J82 and SCaBER, as well as the fibroblast line NIH 3T3 (American Type Culture Collection) are maintained in media supplemented with L-glutamine and 10% FBS. J82-158P3D2 and 3T3-158P3D2 cell populations are generated by retroviral gene transfer as described in Hubert, R. S., et al., Proc. Natl. Acad. Sci. USA, 1999, 96(25): 14523.

Xenograft Mouse Models

Subcutaneous (s.c.) tumors are generated by injection of $1 \times 10^6$ cancer cells mixed at a 1:1 dilution with Matrigel® (Collaborative Research) in the right flank of male SCID mice. To test antibody efficacy on tumor formation, i.p. antibody injections are started on the same day as tumor-cell injections. As a control, mice are injected with either purified mouse IgG (ICN) or PBS; or a purified monoclonal antibody that recognizes an irrelevant protein not expressed in human cells. Tumor sizes are determined by caliper measurements, and the tumor volume is calculated as: Length×Width×Height. Mice with s.c. tumors greater than 1.5 cm in diameter are sacrificed.

Orthotopic injections are performed under anesthesia by using ketamine/xylazine. For bladder orthotopic studies, an incision is made through the abdomen to expose the bladder, and tumor cells ($5 \times 10^5$) mixed with Matrigel® are injected into the bladder wall in a 10-µl volume. To monitor tumor growth, mice are palpated and blood is collected on a weekly basis to measure BTA levels. For prostate orthopotic models, an incision is made through the abdominal muscles to expose the bladder and seminal vesicles, which then are delivered through the incision to expose the dorsal prostate. Tumor cells, e.g. SCaBER cells ($5 \times 10^5$) mixed with Matrigel® are injected into the bladder in a 10-µl volume (Yoshida Y et al, Anticancer Res. 1998, 18:327; Ahn et al, Tumor Biol. 2001, 22:146). The mice are segregated into groups for the appropriate treatments, with anti-158P3D2 or control MAbs being injected i.p.

Anti-158P3D2 MAbs Inhibit Growth of 158P3D2-Expressing Xenograft-Cancer Tumors

The effect of anti-158P3D2 MAbs on tumor formation is tested on the growth and progression of bladder cancer xenografts using SCaBER and J82-158P3D2 orthotopic models. As compared with the s.c. tumor model, the orthotopic model, which requires injection of tumor cells directly in the mouse bladder, and prostate, respectively, results in a local tumor growth, development of metastasis in distal sites, deterioration of mouse health, and subsequent death (Saffran, D., et al., PNAS supra; Fu, X., et al., Int J Cancer, 1992. 52(6): p. 987-90; Kubota, T., J Cell Biochem., 1994. 56(1): p. 4-8). The features make the orthotopic model more representative of human disease progression and allowed us to follow the therapeutic effect of MAbs on clinically relevant end points.

Accordingly, tumor cells are injected into the mouse bladder, or lung, and 2 days later, the mice are segregated into two groups and treated with either: a) 200-500 µg of anti-158P3D2 MAb, or b) PBS three times per week for two to five weeks.

A major advantage of the orthotopic cancer models is the ability to study the development of metastases. Formation of metastasis in mice bearing established orthotopic tumors is studies by IHC analysis on lung sections using an antibody against a tumor-specific cell-surface protein such as anti-cytokeratin 20 for bladder cancer models (Lin S et al, Cancer Detect Prev. 2001; 25:202).

Mice bearing established orthotopic tumors are administered 1000 µg injections of either anti-158P3D2 MAb or PBS over a 4-week period. Mice in both groups are allowed to establish a high tumor burden, to ensure a high frequency of metastasis formation in mouse lungs. Mice then are killed and their bladders, livers, bone and lungs are analyzed for the presence of tumor cells by IHC analysis.

Anti-158P3D2 antibodies inhibit the formation of tumors, retard the growth of already established tumors, and prolong the survival of treated mice. Moreover, anti-158P3D2 MAbs demonstrate a dramatic inhibitory effect on the spread of local bladder tumors to distal sites, even in the presence of a large tumor burden. Thus, anti-158P3D2 MAbs are efficacious on major clinically relevant end points (tumor growth), prolongation of survival, and health.

Example 39

Therapeutic and Diagnostic Use of Anti-158P3D2 Antibodies in Humans

Anti-158P3D2 monoclonal antibodies are safely and effectively used for diagnostic, prophylactic, prognostic and/or therapeutic purposes in humans. Western blot and immunohistochemical analysis of cancer tissues and cancer xenografts with anti-158P3D2 mAb show strong extensive staining in carcinoma but significantly lower or undetectable levels in normal tissues. Detection of 158P3D2 in carcinoma and in metastatic disease demonstrates the usefulness of the mAb as a diagnostic and/or prognostic indicator. Anti-158P3D2 antibodies are therefore used in diagnostic applications such as immunohistochemistry of kidney biopsy specimens to detect cancer from suspect patients.

As determined by flow cytometry, anti-158P3D2 mAb specifically binds to carcinoma cells. Thus, anti-158P3D2 antibodies are used in diagnostic whole body imaging applications, such as radioimmunoscintigraphy and radioimmunotherapy, (see, e.g., Potamianos S., et. al. Anticancer Res 20(2A):925-948 (2000)) for the detection of localized and metastatic cancers that exhibit expression of 158P3D2. Shedding or release of an extracellular domain of 158P3D2 into the extracellular milieu, such as that seen for alkaline phosphodiesterase B10 (Meerson, N. R., Hepatology 27:563-568 (1998)), allows diagnostic detection of 158P3D2 by anti-158P3D2 antibodies in serum and/or urine samples from suspect patients.

Anti-158P3D2 antibodies that specifically bind 158P3D2 are used in therapeutic applications for the treatment of cancers that express 158P3D2. Anti-158P3D2 antibodies are used as an unconjugated modality and as conjugated form in which the antibodies are attached to one of various therapeutic or imaging modalities well known in the art, such as a prodrugs, enzymes or radioisotopes. In preclinical studies, unconjugated and conjugated anti-158P3D2 antibodies are tested for efficacy of tumor prevention and growth inhibition in the SCID mouse cancer xenograft models, e.g., kidney cancer models AGS-K3 and AGS-K6, (see, e.g., the Example entitled "158P3D2 Monoclonal Antibody-mediated Inhibition of Bladder and Lung Tumors In Vivo"). Either conjugated and unconjugated anti-158P3D2 antibodies are used as a therapeutic modality in human clinical trials either alone or in combination with other treatments as described in following Examples.

Example 40

Human Clinical Trials for the Treatment and Diagnosis of Human Carcinomas Through Use of Human Anti-158P3D2 Antibodies In Vivo Antibodies are used in accordance with the present invention which recognize an epitope on 158P3D2, and are used in the treatment of certain tumors such as those listed in Table I. Based upon a number of factors, including 158P3D2 expression levels, tumors such as those listed in Table I are presently preferred indications. In connection with each of these indications, three clinical approaches are successfully pursued.

Adjunctive therapy: In adjunctive therapy, patients are treated with anti-158P3D2 antibodies in combination with a chemotherapeutic or antineoplastic agent and/or radiation therapy. Primary cancer targets, such as those listed in Table I, are treated under standard protocols by the addition anti-158P3D2 antibodies to standard first and second line therapy. Protocol designs address effectiveness as assessed by reduction in tumor mass as well as the ability to reduce usual doses of standard chemotherapy. These dosage reductions allow additional and/or prolonged therapy by reducing dose-related toxicity of the chemotherapeutic agent. Anti-158P3D2 antibodies are utilized in several adjunctive clinical trials in combination with the chemotherapeutic or antineoplastic agents adriamycin (advanced prostrate carcinoma), cisplatin (advanced head and neck and lung carcinomas), taxol (breast cancer), and doxorubicin (preclinical).

Monotherapy: In connection with the use of the anti-158P3D2 antibodies in monotherapy of tumors, the antibodies are administered to patients without a chemotherapeutic or antineoplastic agent. In one embodiment, monotherapy is conducted clinically in end stage cancer patients with extensive metastatic disease. Patients show some disease stabilization. Trials demonstrate an effect in refractory patients with cancerous tumors.

Imaging Agent: Through binding a radionuclide (e.g., iodine or yttrium ($I^{131}$, $Y^{90}$) to anti-158P3D2 antibodies, the radiolabeled antibodies are utilized as a diagnostic and/or imaging agent. In such a role, the labeled antibodies localize to both solid tumors, as well as, metastatic lesions of cells expressing 158P3D2. In connection with the use of the anti-158P3D2 antibodies as imaging agents, the antibodies are used as an adjunct to surgical treatment of solid tumors, as both a pre-surgical screen as well as a post-operative follow-up to determine what tumor remains and/or returns. In one embodiment, a ($^{111}$In)-158P3D2 antibody is used as an imaging agent in a Phase I human clinical trial in patients having a carcinoma that expresses 158P3D2 (by analogy see, e.g., Divgi et al. *J. Natl. Cancer Inst.* 83:97-104 (1991)). Patients are followed with standard anterior and posterior gamma camera. The results indicate that primary lesions and metastatic lesions are identified.

Dose and Route of Administration

As appreciated by those of ordinary skill in the art, dosing considerations can be determined through comparison with the analogous products that are in the clinic. Thus, anti-158P3D2 antibodies can be administered with doses in the range of 5 to 400 mg/m$^2$, with the lower doses used, e.g., in connection with safety studies. The affinity of anti-158P3D2 antibodies relative to the affinity of a known antibody for its target is one parameter used by those of skill in the art for determining analogous dose regimens. Further, anti-158P3D2 antibodies that are fully human antibodies, as compared to the chimeric antibody, have slower clearance; accordingly, dosing in patients with such fully human anti-158P3D2 antibodies can be lower, perhaps in the range of 50 to 300 mg/m$^2$, and still remain efficacious. Dosing in mg/m$^2$, as opposed to the conventional measurement of dose in mg/kg, is a measurement based on surface area and is a convenient dosing measurement that is designed to include patients of all sizes from infants to adults.

Three distinct delivery approaches are useful for delivery of anti-158P3D2 antibodies. Conventional intravenous delivery is one standard delivery technique for many tumors. However, in connection with tumors in the peritoneal cavity, such as tumors of the ovaries, biliary duct, other ducts, and the like, intraperitoneal administration may prove favorable for obtaining high dose of antibody at the tumor and to also minimize antibody clearance. In a similar manner, certain solid tumors possess vasculature that is appropriate for regional perfusion. Regional perfusion allows for a high dose of antibody at the site of a tumor and minimizes short term clearance of the antibody.

Clinical Development Plan (CDP)

Overview: The CDP follows and develops treatments of anti-158P3D2 antibodies in connection with adjunctive therapy, monotherapy, and as an imaging agent. Trials initially demonstrate safety and thereafter confirm efficacy in repeat doses. Trails are open label comparing standard chemotherapy with standard therapy plus anti-158P3D2 antibodies. As will be appreciated, one criteria that can be utilized in connection with enrollment of patients is 158P3D2 expression levels in their tumors as determined by biopsy.

As with any protein or antibody infusion-based therapeutic, safety concerns are related primarily to (i) cytokine release syndrome, i.e., hypotension, fever, shaking, chills; (ii) the development of an immunogenic response to the material (i.e., development of human antibodies by the patient to the antibody therapeutic, or HAHA response); and, (iii) toxicity to normal cells that express 158P3D2. Standard tests and follow-up are utilized to monitor each of these safety concerns. Anti-158P3D2 antibodies are found to be safe upon human administration.

Example 41

Human Clinical Trial Adjunctive Therapy with Human Anti-158P3D2 Antibody and Chemotherapeutic Agent A phase I human clinical trial is initiated to assess the safety of six intravenous doses of a human anti-158P3D2 antibody in connection with the treatment of a solid tumor, e.g., a cancer of a tissue listed in Table I. In the study, the safety of single doses of anti-158P3D2 antibodies when utilized as an adjunctive therapy to an antineoplastic or chemotherapeutic agent as defined herein, such as, without limitation: cisplatin, topotecan, doxorubicin, adriamycin, taxol, or the like, is assessed. The trial design includes delivery of six single doses of an anti-158P3D2 antibody with dosage of antibody escalating from approximately about 25 mg/m$^2$ to about 275 mg/m$^2$ over the course of the treatment in accordance with the following schedule:

|  | Day 0 | Day 7 | Day 14 | Day 21 | Day 28 | Day 35 |
| --- | --- | --- | --- | --- | --- | --- |
| mAb Dose | 25 mg/m$^2$ | 75 mg/m$^2$ | 125 mg/m$^2$ | 175 mg/m$^2$ | 225 mg/m$^2$ | 275 mg/m$^2$ |
| Chemotherapy (standard dose) | + | + | + | + | + | + |

Patients are closely followed for one-week following each administration of antibody and chemotherapy. In particular, patients are assessed for the safety concerns mentioned above: (i) cytokine release syndrome, i.e., hypotension, fever, shaking, chills; (ii) the development of an immunogenic response to the material (i.e., development of human antibodies by the patient to the human antibody therapeutic, or HAHA response); and, (iii) toxicity to normal cells that express 158P3D2. Standard tests and follow-up are utilized to monitor each of these safety concerns. Patients are also assessed for clinical outcome, and particularly reduction in tumor mass as evidenced by MRI or other imaging.

The anti-158P3D2 antibodies are demonstrated to be safe and efficacious, Phase II trials confirm the efficacy and refine optimum dosing.

Example 42

Human Clinical Trial

Monotherapy with Human Anti-158P3D2 Antibody

Anti-158P3D2 antibodies are safe in connection with the above-discussed adjunctive trial, a Phase II human clinical trial confirms the efficacy and optimum dosing for monotherapy. Such trial is accomplished, and entails the same safety and outcome analyses, to the above-described adjunctive trial with the exception being that patients do not receive chemotherapy concurrently with the receipt of doses of anti-158P3D2 antibodies.

Example 43

Human Clinical Trial

Diagnostic Imaging with Anti-158P3D2 Antibody

Once again, as the adjunctive therapy discussed above is safe within the safety criteria discussed above, a human clinical trial is conducted concerning the use of anti-158P3D2 antibodies as a diagnostic imaging agent. The protocol is designed in a substantially similar manner to those described in the art, such as in Divgi et al. *J. Natl. Cancer Inst.* 83:97-104 (1991). The antibodies are found to be both safe and efficacious when used as a diagnostic modality.

Example 44

158P3D2 Functional Assays

158P3D2 protein, and variants thereof, is a member of a family of related proteins, the ferlins. This family of membrane proteins is characterized by the presence of intracellular C2 domains, so named by their homology to a conserved protein kinase C (PKC) motif. The canonical C2 domain is a 130 amino acid long $Ca^{2+}$ dependent membrane targeting module that is found in proteins involved in signal transduction or membrane trafficking (Rizo, J. and Sudhof, T. C., J. Biol. Chem. 273, 15879-82 (1998)). The function of the C2 domain amongst the >100 proteins identified to date varies between these proteins, however a common feature is that the C2 domain has been shown to bind to phospholipids, particularly phosphatidylserine and phosphatidylcholine. In some cases, the C2 domain may not bind to $Ca^{2+}$ or to phospholipids but rather to other proteins (Rizo, J. and Sudhof, T. C., J. Biol. Chem. 273, 15879-82 (1998)). 158P3D2, and variants thereof, are $Ca^{2+}$ binding proteins with the capacity to bind to both phospholipids and to proteins. The different variants of 158P3D2, which express different numbers of C2 domains, have different functions with respect to the unique combinations of expressed C2 regions.

Dysferlin is a member of this family of C2 containing proteins that has a function in muscle membrane repair. Human mutation of dysferlin leads to specific autosomal recessive muscular dystrophies (limb-girdle MD type 2B and Miyoshi myopathy) (reviewed in Bansal, D. and Campbell, K. P., Trends in Cell Biol. 14, 206-213). Dysferlin is localized in the plasma membrane of cells where it interacts with annexin A1 and A2, and is also found in vesicles. Membrane disruption (for example in muscle) causes an increase of localized $Ca^{2+}$ at the wound site and an accumulation of vesicles containing dysferlin. The dysferlin protein facilitates both docking and fusion of the vesicles with the plasma membrane through interaction with the annexins and/or other membrane-associated proteins. Fusion between the repair vesicles and the plasma membrane seals the wound (Bansal, D. and Campbell, K. P., Trends in Cell Biol. 14, 206-213).

158P3D2 protein, and variants thereof, functions in a similar fashion as dysferlin by inducing repair of cellular plasma membranes following their disruption. Given the high rate of cell division and stress conditions such as hypoxia and reduced nutrient supply during tumor formation, membrane repair becomes a critical component of tumor survival. Expression of 158P3D2, and variants thereof, on tumors provides an advantage for such cells to grow under stressful conditions such as hypoxia or nutrient deprivation.

The C2 domain of the lipid phosphatase/tumor suppressor PTEN is regulated by threonine phosphorylation (Raftopolou, M., et al., 2004, Science, 303, 1179-81). This phosphorylation event inhibits cell migration independent of the lipid phosphatase activity, which may relate to the tumor suppressive activity of PTEN. However, given the regulation of C2-induced function by phosphorylation, the status of that phosphorylation event alters the migratory capacity of the cell. 158P3D2 protein, and variants thereof, reside in the plasma membrane of tumor cells as C2-containing regulators of cell migration due to alterations in the phosphorylation status of 158P3D2. Upon phosphorylation of 158P3D2, the C2 domains influence the migratory capacity of 158P3D2-positive tumor cells, conferring an advantage for them to migrate to distal sites to seek secondary growth (metastasis). 158P3D2, and variants thereof, also bind to signal transduction proteins, providing important signaling cascades for tumor cells that confer a growth advantage and increased capacity for cell migration and adhesion. Such advantages are key elements for increased survival and metastasis for bladder, lung, colon and breast cancer cells.

Enhanced proliferation and entry into S-phase of tumor cells relative to normal cells is a hallmark of the cancer cell phenotype. To address the effect of expression of 158P3D2 on the proliferation rate of normal cells, two rodent cell lines (3T3 and Rat-1) are infected with virus containing the 158P3D2 gene and stable cells expressing 158P3D2 antigen are derived, as well as empty vector control cells expressing the selection marker neomycin (Neo). The cells are grown overnight in 0.5% FBS and then compared to cells treated with 10% FBS. The cells are evaluated for proliferation at 18-96 hr post-treatment by a $^3$H-thymidine incorporation assay and for cell cycle analysis by a BrdU incorporation/propidium iodide staining assay. Rat-1 cells expressing the 158P3D2 antigen grow effectively in low serum concentrations (0.1%) compared to the Rat-1-Neo cells. Similar data are obtained for the 3T3 cells expressing 158P3D2 versus Neo only. To assess cell proliferation by another methodology, the cells are stained with BrdU and propidium iodide. Briefly, cells are labeled with 10 μM BrdU, washed, trypsinized and fixed in 0.4% paraformaldehyde and 70% ethanol. Anti-BrdU-FITC (Pharmigen) is added to the cells, the cells are washed and then incubated with 10 μg/ml propidium iodide for 20 min prior to washing and analysis for fluorescence at 488 nm. An increase in labeling of cells in S-phase (DNA synthesis phase of the cell cycle) in 3T3 cells that express the 158P3D2 protein is observed relative to control cells. This confirms the results of those measured by $^3$H-thymidine incorporation. Accordingly, 158P3D2 expressing cells have increased potential for growth as tumor cells in vivo during stress, including nutrient deprivation, hypoxia or reduced osmolarity.

Example 45

158P3D2 RNA Interference (RNAi)

RNA interference (RNAi) technology is implemented to a variety of cell assays relevant to oncology. RNAi is a post-transcriptional gene silencing mechanism activated by double-stranded RNA (dsRNA). RNAi induces specific mRNA degradation leading to changes in protein expression and subsequently in gene function. In mammalian cells, these dsRNAs called short interfering RNA (siRNA) have the correct composition to activate the RNAi pathway targeting for degradation, specifically some mRNAs. See, Elbashir S. M., et al., *Duplexes of 21-nucleotide RNAs Mediate RNA interference in Cultured Mammalian Cells*, Nature 411(6836): 494-8 (2001). Thus, RNAi technology is used successfully in mammalian cells to silence targeted genes.

Loss of cell proliferation control is a hallmark of cancerous cells; thus, assessing the role of 158P3D2 in cell survival/proliferation assays is relevant. Accordingly, RNAi was used to investigate the function of the 158P3D2 antigen. To generate siRNA for 158P3D2, algorithms were used that predict oligonucleotides that exhibit the critical molecular parameters (G:C content, melting temperature, etc.) and have the ability to significantly reduce the expression levels of the 158P3D2 protein when introduced into cells. Accordingly, one targeted sequence for the 158P3D2 siRNA is: 5'CCTCG-GCAGCCAATCAGCTAT 3' (SEQ ID NO: 104) (oligo 158P3D2.b). In accordance with this Example, 158P3D2 siRNA compositions are used that comprise siRNA (double stranded, short interfering RNA) that correspond to the nucleic acid ORF sequence of the 158P3D2 protein or subsequences thereof. Thus, siRNA subsequences are used in this manner are generally 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 or more than 35 contiguous RNA nucleotides in length. These siRNA sequences are complementary and non-complementary to at least a portion of the mRNA coding sequence. In a preferred embodiment, the subsequences are 19-25 nucleotides in length, most preferably 21-23 nucleotides in length. In preferred embodiments, these siRNA achieve knockdown of 158P3D2 antigen in cells expressing the protein and have functional effects as described below.

The selected siRNA (158P3D2.b oligo) was tested in numerous cell lines in the thymidine incorporation/proliferation assay (measures $^3$H-Thy uptake and incorporation into DNA). Moreover, this 158P3D2.b oligo achieved knockdown of 158P3D2 antigen in cells expressing the protein and had functional effects as described below using the following protocols.

Mammalian siRNA transfections: The day before siRNA transfection, the different cell lines were plated in media (RPMI 1640 with 10% FBS w/o antibiotics) at $2\times10^3$ cells/well in 80 µl (96 well plate format) for the survival/MTS assay. In parallel with the 158P3D2 specific siRNA oligo, the following sequences were included in every experiment as controls: a) Mock transfected cells with Lipofectamine 2000 (Invitrogen, Carlsbad, Calif.) and annealing buffer (no siRNA); b) Luciferase-4 specific siRNA (targeted sequence: 5'-AAGGGACGAAGACGAACACUUCTT-3') (SEQ ID NO: 105); and, c) Eg5 specific siRNA (targeted sequence: 5'-AACTGAAGACCTGAAGACAATAA-3') (SEQ ID NO: 106). SiRNAs were used at 10 nM and 1 µg/ml Lipofectamine 2000 final concentration.

The procedure was as follows: The siRNAs were first diluted in OPTIMEM (serum-free transfection media, Invitrogen) at 0.1 uM µM (10-fold concentrated) and incubated 5-10 min RT. Lipofectamine 2000 was diluted at 10 µg/ml (10-fold concentrated) for the total number transfections and incubated 5-10 minutes at room temperature (RT). Appropriate amounts of diluted 10-fold concentrated Lipofectamine 2000 were mixed 1:1 with diluted 10-fold concentrated siRNA and incubated at RT for 20-30" (5-fold concentrated transfection solution). 20 µls of the 5-fold concentrated transfection solutions were added to the respective samples and incubated at 37° C. for 96 hours before analysis.

$^3$H-Thymidine incorporation assay: The proliferation assay is a $^3$H-thymidine incorporation method for determining the proliferation of viable cells by uptake and incorporation of label into DNA.

The procedure was as follows: Cells growing in log phase are trypsinized, washed, counted and plated in 96-well plates at 1000-4000 cells/well in 10% FBS. After 4-8 hrs, the media is replaced. The cells are incubated for 24-72 hrs, pulsed with $^3$H-Thy at 1.5 µCi/ml for 14 hrs, harvested onto a filtermat and counted in scintillation cocktail on a Microbeta trilux or other counter.

To address the validation of the 158P3D2 siRNA in reducing the expression of 158P3D2 protein in cells, Cos-1 cells were transfected with pcDNA.3 vector expressing a Myc/His-tagged version of 158P3D2 alone (LF2k) or together with siRNA for either CT1 (bacterial negative control) or 158P3D2 oligo (158P3D2.b). For additional control, a mock transfection was also included (No DNA). Western blot analysis using an antibody to the Myc tag on 158P3D2 protein showed that the 158P3D2 siRNA significantly reduced the expression level of 158P3D2 protein (FIG. 30). These data show that the specific 158P3D2.b siRNA will have utility to probe the function of 158P3D2 protein in cells.

In order to address the function of 158P3D2 in cells, 158P3D2 was silenced by transfecting the endogenously expressing 158P3D2 cell lines (SCaBER, a bladder cancer cell line) with the 158P3D2 specific siRNA (158P3D2.b) along with negative siRNA controls (Luc4, targeted sequence not represented in the human genome) and a positive siRNA control (targeting Eg5) (See FIG. 4). SCaBER cells were shown to express 158P3D2 by Northern blot of total cellular RNA. The results indicated that when these cells were treated with siRNA specifically targeting the 158P3D2 mRNA, the resulting "158P3D2 deficient cells" showed diminished cell proliferation as measured by this assay (see oligo 158P3D2.b treated cells). This effect is likely caused by an active induction of apoptosis. The reduced viability is measured by the decreased uptake of labeled thymidine.

As control, Cos-1 cells, a cell line with no detectable expression of 158P3D2 mRNA or protein (by Western blot), was also treated with the panel of siRNAs (including oligo 158P3D2.b) and no phenotype was observed (FIG. 4). This result reflects the fact that the specific protein knockdown in the SCaBER cells is not a function of general toxicity, since the Cos-1 cells did not respond to the 158P3D2.b oligo. The differential response of the two cell lines to the Eg5 control is a reflection of differences in levels of cell transfection and responsiveness of the cell lines to oligo treatment (FIG. 4).

Together, these data indicate that 158P3D2, and variants thereof, play important roles in the proliferation of cancer cells and that the lack of 158P3D2 clearly decreases the survival potential of these cells. It is to be noted that 158P3D2 is constitutively expressed in many tumor cell lines. 158P3D2 serves a role in malignancy; it expression is a primary indicator of disease, where such disease is often characterized by high rates of uncontrolled cell proliferation and diminished apoptosis. Correlating cellular phenotype with gene knockdown following RNAi treatments is important, and allows one to draw valid conclusions and rule out toxicity or other non-specific effects of these reagents. To this end, assays to measure the levels of expression of both protein and mRNA for the target after RNAi treatments are important, including Western blotting, FACS staining with antibody, immunoprecipitation, Northern blotting or RT-PCR (Taqman or standard methods). Any phenotypic effect of the siRNAs in these assays should be correlated with the protein and/or mRNA knockdown levels in the same cell lines. Knockdown of 158P3D2 is achieved using the 158P3D2.b oligo as measured by Western blotting and RT-PCR analysis.

Another method to analyze 158P3D2 related cell proliferation is performing clonogenic assays. In these assays, a defined number of cells are plated onto the appropriate matrix and the number of colonies formed after a period of growth following siRNA treatment is counted.

In 158P3D2 cancer target validation, complementing the cell survival/proliferation analysis with apoptosis and cell cycle profiling studies are considered. The biochemical hallmark of the apoptotic process is genomic DNA fragmentation, an irreversible event that commits the cell to die. A method to observe fragmented DNA in cells is the immunological detection of histone-complexed DNA fragments by an immunoassay (i.e. cell death detection ELISA) which measures the enrichment of histone-complexed DNA fragments (mono- and oligo-nucleosomes) in the cytoplasm of apoptotic cells. This assay does not require pre-labeling of the cells and can detect DNA degradation in cells that do not proliferate in vitro (i.e. freshly isolated tumor cells).

The most important effector molecules for triggering apoptotic cell death are caspases. Caspases are proteases that when activated cleave numerous substrates at the carboxy-terminal site of an aspartate residue mediating very early stages of apoptosis upon activation. All caspases are synthesized as pro-enzymes and activation involves cleavage at aspartate residues. In particular, caspase 3 seems to play a central role in the initiation of cellular events of apoptosis. Assays for determination of caspase 3 activation detect early events of apoptosis. Following RNAi treatments, Western blot detection of active caspase 3 presence or proteolytic cleavage of products (i.e. PARP) found in apoptotic cells further support an active induction of apoptosis. Because the cellular mechanisms that result in apoptosis are complex, each has its advantages and limitations. Consideration of other criteria/endpoints such as cellular morphology, chromatin condensation, membrane blebbing, apoptotic bodies help to further support cell death as apoptotic. Since not all the gene targets that regulate cell growth are anti-apoptotic, the DNA content of permeabilized cells is measured to obtain the profile of DNA content or cell cycle profile. Nuclei of apoptotic cells contain less DNA due to the leaking out to the cytoplasm (sub-G1 population). In addition, the use of DNA stains (i.e., propidium iodide) also differentiates between the different phases of the cell cycle in the cell population due to the presence of different quantities of DNA in G0/G1, S and G2/M. In these studies the subpopulations can be quantified.

For the 158P3D2 gene, RNAi studies facilitate the understanding of the contribution of the gene product in cancer pathways. Such active RNAi molecules have use in identifying assays to screen for mAbs that are active anti-tumor therapeutics. Further, siRNA are administered as therapeutics to cancer patients for reducing the malignant growth of several cancer types, including those listed in Table 1. When 158P3D2 (and variants) plays a role in cell survival, cell proliferation, tumorigenesis, or apoptosis, it is used as a target for diagnostic, prognostic, preventative and/or therapeutic purposes.

Example 46

Homology Comparison of 158P3D2 to Known Sequences

The 158P3D2 v.17 protein has 2036 amino acids with a calculated molecular weight of 227.6 kDa and a pI of 5.64. 158P3D2 is predicted to be a predominantly cytoplasmic protein with plasma membrane association (PSORT-II). 158P3D2 contains a single transmembrane region from amino acids 2000-2022 with high probability that the amino-terminus resides outside, consistent with the topology of a type I transmembrane protein. Based on the TMpred algorithm of Hofmann and Stoffel which utilizes TMBASE (K. Hofmann, W. Stoffel, TMBASE-A database of membrane spanning protein segments Biol. Chem. Hoppe-Seyler 374: 166, 1993), 158P3D2 contains a primary transmembrane region from amino acids 2003-2020 (contiguous amino acids with values greater than 0 on the plot have high probability of being transmembrane regions) with an orientation in which the amino terminus resides inside and the carboxyl terminus outside (type II). Another transmembrane algorithm indicated that 158P3D2 contains a transmembrane domain from amino acids 2003-2022, with the N-terminus oriented intracellularly consistent with a type II topology. The transmembrane prediction algorithms are accessed through the ExPasy molecular biology server.

By use of the PubMed website of the N.C.B.I., it was found at the protein level that 158P3D2 v.17 shows 60% homology and 40% identity with human otoferlin, a member of the ferlin family of plasma membrane proteins. Further, 158P3D2 v.17 shows 50% homology and 30% identity with dysferlin, another member of the ferlin family, and 80% homology and 75% identity with the murine gene Fer-1-like 4.

The ferlins are a family of transmembrane proteins that have function in membrane trafficking, including the repair of cell membranes. Mutation of human otoferlin leads to a specific form of nonsyndromic autosomal recessive deafness (DFNB9) and mutations in dysferlin lead to two subtypes of muscular dystrophies (reviewed in Bansal, D. and Campbell, K. P., Trends in Cell Biol. 14, 206-213). The major feature of the ferlin family includes multiple C2 domains (conserved PKC homologous region) that function in both $Ca^{2+}$ dependent and $Ca^{2+}$ independent phospholipid binding, as well as protein binding. The mechanism of action for dysferlin includes the repair of muscle cell membrane disruptions through dysferlin-containing cell vesicles. Such vesicles are tethered to the site of membrane tears (where $Ca^{2+}$ concentrations are increased) via dysferlin molecules that interact with plasma membrane associated annexin A1 and annexin A2 molecules. The vesicles provide the lipid bilayer material to seal the wound.

158P3D2 associates with cell vesicles and the plasma membrane thereby providing a means for tumor cells to repair membranes during tumor growth and metastasis. Such a functional advantage can be exemplified by the increased stress that tumors experience, including increased hypoxia, decreased nutrition and increases in free radical formation. These stresses can alter membrane integrity, thereby increasing the need for robust plasma membrane repair mechanisms. In addition, the C2 domains of 158P3D2, and variants thereof, regulate migration of tumor cells expressing this protein. The regulation of the C2 domains occurs through the phosphorylation of threonine residues (Raftopolou, M., et al., 2004, Science, 303, 1179-81) and modulates the ability of the expressing cells to migrate. This signal transduction property of the 158P3D2 protein expressed in tumor cells enhances their ability to migrate during metastases, facilitates their homing to distal sites (lymph nodes), and promotes interactions with other cells during the formation of tumor masses. Further, the C2 domains of 158P3D2 play a role in membrane trafficking though interaction with $Ca^{2+}$, phosphatidylserine and phosphatidylcholine (Rizo, J. and Sudhof, T. C., J. Biol. Chem. 273, 15879-82 (1998). These interactions are crucial for subsequent membrane metabolism and interaction. Taken together, the 158P3D2 protein significantly promotes unregulated growth of cancer cells, contributing to their viability and metastatic advantage in vivo.

The present invention is not to be limited in scope by the embodiments disclosed herein, which are intended as single illustrations of individual aspects of the invention, and any that are functionally equivalent are within the scope of the invention. Various modifications to the models and methods of the invention, in addition to those described herein, will become apparent to those skilled in the art from the foregoing description and teachings, and are similarly intended to fall within the scope of the invention. Such modifications or other embodiments can be practiced without departing from the true scope and spirit of the invention.

Tables

XV.)

TABLE I

TISSUES THAT EXPRESS 158P3D2 WHEN MALIGNANT.

Prostate
Bladder
Kidney
Colon
Ovary
Lung
Breast
Pancreas
Stomach
Cervix
Lymph node
Uterus

XVI.)

TABLE II

AMINO ACID ABBREVIATIONS

| SINGLE LETTER | THREE LETTER | FULL NAME |
| --- | --- | --- |
| F | Phe | phenylalanine |
| L | Leu | leucine |
| S | Ser | serine |
| Y | Tyr | tyrosine |
| C | Cys | cysteine |
| W | Trp | tryptophan |
| P | Pro | proline |
| H | His | histidine |
| Q | Gln | glutamine |
| R | Arg | arginine |
| I | Ile | isoleucine |
| M | Met | methionine |
| T | Thr | threonine |
| N | Asn | asparagine |
| K | Lys | lysine |
| V | Val | valine |
| A | Ala | alanine |
| D | Asp | aspartic acid |
| E | Glu | glutamic acid |
| G | Gly | glycine |

TABLE III

Amino Acid Substitution Matrix
Adapted from the GCG Software 9.0 BLOSUM62 amino acid substitution matrix (block substitution matrix). The higher the value, the more likely a substitution is found in related, natural proteins. (See world wide web URL ikp.unibe.ch/manual/blosum62.html)

| A | C | D | E | F | G | H | I | K | L | M | N | P | Q | R | S | T | V | W | Y | . |
| --- | --- | --- | --- | --- | --- | --- | --- | --- | --- | --- | --- | --- | --- | --- | --- | --- | --- | --- | --- | --- |
| 4 | 0 | -2 | -1 | -2 | 0 | -2 | -1 | -1 | -1 | -1 | -2 | -1 | -1 | -1 | 1 | 0 | 0 | -3 | -2 | A |
|  | 9 | -3 | -4 | -2 | -3 | -3 | -1 | -3 | -1 | -1 | -3 | -3 | -3 | -3 | -1 | -1 | -1 | -2 | -2 | C |
|  |  | 6 | 2 | -3 | -1 | -1 | -3 | -1 | -4 | -3 | 1 | -1 | 0 | -2 | 0 | -1 | -3 | -4 | -3 | D |
|  |  |  | 5 | -3 | -2 | 0 | -3 | 1 | -3 | -2 | 0 | -1 | 2 | 0 | 0 | -1 | -2 | -3 | -2 | E |
|  |  |  |  | 6 | -3 | -1 | 0 | -3 | 0 | 0 | -3 | -4 | -3 | -3 | -2 | -2 | -1 | 1 | 3 | F |
|  |  |  |  |  | 6 | -2 | -4 | -2 | -4 | -3 | 0 | -2 | -2 | -2 | 0 | -2 | -3 | -2 | -3 | G |
|  |  |  |  |  |  | 8 | -3 | -1 | -3 | -2 | 1 | -2 | 0 | 0 | -1 | -2 | -3 | -2 | 2 | H |
|  |  |  |  |  |  |  | 4 | -3 | 2 | 1 | -3 | -3 | -3 | -3 | -2 | -1 | 3 | -3 | -1 | I |
|  |  |  |  |  |  |  |  | 5 | -2 | -1 | 0 | -1 | 1 | 2 | 0 | -1 | -2 | -3 | -2 | K |
|  |  |  |  |  |  |  |  |  | 4 | 2 | -3 | -3 | -2 | -2 | -2 | -1 | 1 | -2 | -1 | L |
|  |  |  |  |  |  |  |  |  |  | 5 | -2 | -2 | 0 | -1 | -1 | -1 | 1 | -1 | -1 | M |
|  |  |  |  |  |  |  |  |  |  |  | 6 | -2 | 0 | 0 | 1 | 0 | -3 | -4 | -2 | N |
|  |  |  |  |  |  |  |  |  |  |  |  | 7 | -1 | -2 | -1 | -1 | -2 | -4 | -3 | P |
|  |  |  |  |  |  |  |  |  |  |  |  |  | 5 | 1 | 0 | -1 | -2 | -2 | -1 | Q |
|  |  |  |  |  |  |  |  |  |  |  |  |  |  | 5 | -1 | -1 | -3 | -3 | -2 | R |
|  |  |  |  |  |  |  |  |  |  |  |  |  |  |  | 4 | 1 | -2 | -3 | -2 | S |
|  |  |  |  |  |  |  |  |  |  |  |  |  |  |  |  | 5 | 0 | -2 | -2 | T |
|  |  |  |  |  |  |  |  |  |  |  |  |  |  |  |  |  | 4 | -3 | -1 | V |
|  |  |  |  |  |  |  |  |  |  |  |  |  |  |  |  |  |  | 11 | 2 | W |
|  |  |  |  |  |  |  |  |  |  |  |  |  |  |  |  |  |  |  | 7 | Y |

TABLE IV

HLA Class I/II Motifs/Supermotifs

TABLE IV (A)

HLA Class I Supermotifs/Motifs

| | POSITION 2 (Primary Anchor) | POSITION 3 (Primary Anchor) | POSITION C Terminus (Primary Anchor) |
| --- | --- | --- | --- |
| SUPERMOTIF | | | |
| A1 | T*ILVMS* | | F*WY* |
| A2 | LIVMATQ | | IVMATL |
| A3 | VSMATLI | | RK |
| A24 | YFWIVLMT | | FIYWLM |
| B7 | P | | VILFMWYA |
| B27 | RHK | | FYLWMIVA |
| B44 | ED | | FWYLIMVA |
| B58 | ATS | | FWYLIVMA |
| B62 | QLIVMP | | FWYMIVLA |
| MOTIFS | | | |
| A1 | TSM | | Y |
| A1 | | DEAS | Y |
| A2.1 | LMVQIAT | | VLIMAT |
| A3 | LMVISATFCGD | | KYRHFA |
| A11 | VTMLISAGNCDF | | KRYH |
| A24 | YFWM | | FLIW |
| A*3101 | MVTALIS | | RK |
| A*3301 | MVALFIST | | RK |
| A*6801 | AVTMSLI | | RK |
| B*0702 | P | | LMFWYAIV |
| B*3501 | P | | LMFWYIVA |
| B51 | P | | LIVFWYAM |
| B*5301 | P | | IMFWYALV |
| B*5401 | P | | ATIVLMFWY |

Bolded residues are preferred, italicized residues are less preferred: A peptide is considered motif-bearing if it has primary anchors at each primary anchor position for a motif or supermotif as specified in the above table.

TABLE IV (B)

| HLA Class II Supermotif | | | |
|---|---|---|---|
| 1 | 6 | 9 | 5 |
| W, F, Y, V, I, L | A, V, I, L, P, C, S, T | A, V, I, L, C, S, T, M, Y | |

TABLE IV (C)

HLA Class II Motifs

| MOTIFS | | 1° anchor 1 | 2 | 3 | 4 | 5 | 1° anchor 6 | 7 | 8 | 9 |
|---|---|---|---|---|---|---|---|---|---|---|
| DR4 | preferred | FMY*LI VW* | M | T | | I | VST*CPA LIM* | MH | | MH |
| | deleterious | | | | W | | | R | | W DE |
| DR1 | preferred | MF*LIV WY* | | | PAMQ | | VMAT*S PLIC* | M | | AVM |
| | deleterious | | C | CH | FD | CWD | | GDE | D | |
| DR7 | preferred | MF*LIV WY* | M | W | A | | IVMSAC *TPL* | M | | IV |
| | deleterious | | C | | G | | | GRD | N | G |
| DR3 | MOTIFS | 1° anchor 1 | 2 | 3 | 1° anchor 4 | 5 | 1° anchor 6 | | | |
| Motif a preferred | | LIVMFY | | | D | | | | | |
| Motif b preferred | | LIVMF AY | | | DNQEST | | KRH | | | |
| DR Supermotif | | MF*LIV WY* | | | | | VMSTA *CPLI* | | | |

Italicized residues indicate less preferred or "tolerated" residues

TABLE IV (D)

HLA Class I Supermotifs

| SUPER-MOTIFS | | 1 | 2 | 3 | 4 | 5 | 6 | 7 | 8 | C-terminus |
|---|---|---|---|---|---|---|---|---|---|---|
| A1 | | | 1°Anchor TI*LVMS* | | | | | | | 1°Anchor FWY |
| A2 | | | 1°Anchor LIVMATQ | | | | | | | 1°Anchor LIVMAT |
| A3 | Preferred | | 1°Anchor VSMA*TLI* | YFW (4/5) | | | YFW (3/5) | YFW (4/5) | P (4/5) | 1°Anchor RK |
| | deleterious | | DE (3/5); P (5/5) | DE (4/5) | | | | | | |
| A24 | | | 1°Anchor YF*WIVLMT* | | | | | | | 1°Anchor FI*YWLM* |
| B7 | Preferred | FWY (5/5) LIVM (3/5) | 1°Anchor P | FWY (4/5) | | | | | FWY (3/5) | 1°Anchor VILF*MWYA* |
| | deleterious | DE (3/5); P(5/5); G(4/5); A(3/5); QN(3/5) | | | | | DE (3/5) | G (4/5) | QN (4/5) | DE (4/5) |
| B27 | | | 1°Anchor RHK | | | | | | | 1°Anchor FYL*WMIVA* |
| B44 | | | 1°Anchor ED | | | | | | | 1°Anchor FWYLIMVA |
| B58 | | | 1°Anchor ATS | | | | | | | 1°Anchor FWYL*IVMA* |
| B62 | | | 1°Anchor QL*IVMP* | | | | | | | 1°Anchor FWYM*IVLA* |

Italicized residues indicate less preferred or "tolerated" residues

TABLE IV (E)

HLA Class I Motifs

| | | POSITION | | | | | | | | |
|---|---|---|---|---|---|---|---|---|---|---|
| | | 1 | 2 | 3 | 4 | 5 | 6 | 7 | 8 | 9 or C-terminus | C-terminus |
| A1 9-mer | preferred | GFYW | 1°Anchor STM | DEA | YFW | | P | DEQN | YFW | 1°Anchor Y | |
| | deleterious | DE | | RHKLIVMP | A | G | A | | | | |
| A1 9-mer | preferred | GRHK | ASTCLIVM | 1°Anchor DEAS | GSTC | | ASTC | LIVM | DE | 1°Anchor Y | |
| | deleterious | A | RHKDEPYFW | | DE | PQN | RHK | PG | GP | | |
| A1 10-mer | preferred | YFW | 1°Anchor STM | DEAQN | A | YFWQN | | PASTC | GDE | P | 1°Anchor Y |
| | deleterious | GP | | RHKGLIVM | DE | RHK | QNA | RHKYFW | RHK | A | |
| A1 10-mer | preferred | YFW | STCLIVM | 1°Anchor DEAS | A | YFW | | PG | G | YFW | 1°Anchor Y |
| | deleterious | RHK | RHKDEPYFW | | | P | G | | PRHK | QN | |
| A2.1 9-mer | preferred | YFW | 1°Anchor LMIVQAT | YFW | STC | YFW | | A | P | 1°Anchor VLIMAT | |
| | deleterious | DEP | | DERKH | | | RKH | DERKH | | | |
| A2.1 10-mer | preferred | AYFW | 1°Anchor LMIVQAT | LVIM | G | | G | | FYWLVIM | 1°Anchor VLIMAT | |
| | deleterious | DEP | | DE | RKHA | P | | RKH | DERKH | RKH | |
| A3 | preferred | RHK | 1°Anchor LMVISATFCGD | YFW | PRHKYFW | A | YFW | | P | 1°Anchor KYRHFA | |
| | deleterious | DEP | | DE | | | | | | | |
| A11 | preferred | A | 1°Anchor VTLMISAGNCDF | YFW | YFW | A | YFW | YFW | P | 1°Anchor KRYH | |
| | deleterious | DEP | | | | | | A | G | | |
| A24 9-mer | preferred | YFWRHK | 1°Anchor YFWM | | STC | | | YFW | YFW | 1°Anchor FLIW | |
| | deleterious | DEG | | DE | G | QNP | DERHK | G | AQN | | |
| A24 10-mer | preferred | | 1°Anchor YFWM | | P | YFWP | | P | | | 1°Anchor FLIW |
| | deleterious | | | GDE | QN | RHK | DE | A | QN | DEA | |
| A3101 | preferred | RHK | 1°Anchor MVTALIS | YFW | P | | YFW | YFW | AP | 1°Anchor RK | |
| | deleterious | DEP | | DE | | ADE | DE | DE | DE | | |
| A3301 | preferred | | 1°Anchor MVALFIST | YFW | | | | AYFW | | 1°Anchor RK | |
| | deleterious | GP | | DE | | | | | | | |
| A1 9-mer | preferred | GFYW | 1°Anchor STM | DEA | YFW | | P | DEQN | YFW | 1°Anchor Y | |
| | deleterious | DE | | RHKLIVMP | A | G | A | | | | |
| A1 9-mer | preferred | GRHK | ASTCLIVM | 1°Anchor DEAS | GSTC | | ASTC | LIVM | DE | 1°Anchor Y | |
| | deleterious | A | RHKDEPYFW | | DE | PQN | RHK | PG | GP | | |
| A6801 | preferred | YFWSTC | 1°Anchor AVTMSLI | | | YFWLIVM | | YFW | P | 1°Anchor RK | |
| | deleterious | GP | | DEG | | RHK | | | A | | |
| B0702 | preferred | RHKFWY | 1°Anchor P | RHK | | RHK | RHK | RHK | PA | 1°Anchor LMFWYAIV | |
| | deleterious | DEQNP | | DEP | DE | DE | GDE | QN | DE | | |
| B3501 | preferred | FWYLIVM | 1°Anchor P | FWY | | DE | | | FWY | 1°Anchor LMFWYIVA | |
| | deleterious | AGP | | | | | G | G | | | |
| B51 | preferred | LIVMFWY | 1°Anchor P | FWY | STC | FWY | | G | FWY | 1°Anchor LIVFWYAM | |
| | deleterious | AGPDERHKSTC | | | | DE | G | DEQN | GDE | | |
| B5301 | preferred | LIVMFWY | 1°Anchor P | FWY | STC | FWY | | LIVMFWY | FWY | 1°Anchor IMFWYALV | |
| | deleterious | AGPQN | | | | | G | RHKQN | DE | | |

TABLE IV (E)-continued

HLA Class I Motifs

| | | 1 | 2 | 3 | 4 | 5 | 6 | 7 | 8 | 9 or C-terminus | C-terminus |
|---|---|---|---|---|---|---|---|---|---|---|---|
| B5401 | preferred | FWY | 1°Anchor P | FWYLIVM | | LIVM | | ALIVM | FWY AP | 1°Anchor ATIV*LM* *FWY* | |
| | deleterious | GPQNDE | | GDESTC | | RHKDE | DE | QNDGE | DE | | |

TABLE IV (F)

Summary of HLA-supertypes
Overall phenotypic frequencies of HLA-supertypes in different ethnic populations

| | Specificity | | Phenotypic frequency | | | | | |
|---|---|---|---|---|---|---|---|---|
| Supertype | Position 2 | C-Terminus | Caucasian | N.A. Black | Japanese | Chinese | Hispanic | Average |
| B7 | P | AILMVFWY | 43.2 | 55.1 | 57.1 | 43.0 | 49.3 | 49.5 |
| A3 | AILMVST | RK | 37.5 | 42.1 | 45.8 | 52.7 | 43.1 | 44.2 |
| A2 | AILMVT | AILMVT | 45.8 | 39.0 | 42.4 | 45.9 | 43.0 | 42.2 |
| A24 | YF (WIVLMT) | FI (YWLM) | 23.9 | 38.9 | 58.6 | 40.1 | 38.3 | 40.0 |
| B44 | E (D) | FWYLIMVA | 43.0 | 21.2 | 42.9 | 39.1 | 39.0 | 37.0 |
| A1 | TI (LVMS) | FWY | 47.1 | 16.1 | 21.8 | 14.7 | 26.3 | 25.2 |
| B27 | RHK | FYL (WMI) | 28.4 | 26.1 | 13.3 | 13.9 | 35.3 | 23.4 |
| B62 | QL (IVMP) | FWY (MIV) | 12.6 | 4.8 | 36.5 | 25.4 | 11.1 | 18.1 |
| B58 | ATS | FWY (LIV) | 10.0 | 25.1 | 1.6 | 9.0 | 5.9 | 10.3 |

TABLE IV (G)

Calculated population coverage afforded by different HLA-supertype combinations

| | Phenotypic frequency | | | | | |
|---|---|---|---|---|---|---|
| HLA-supertypes | Caucasian | N.A Blacks | Japanese | Chinese | Hispanic | Average |
| A2, A3 and B7 | 83.0 | 86.1 | 87.5 | 88.4 | 86.3 | 86.2 |
| A2, A3, B7, A24, B44 and A1 | 99.5 | 98.1 | 100.0 | 99.5 | 99.4 | 99.3 |
| A2, A3, B7, A24, B44, A1, B27, B62, and B 58 | 99.9 | 99.6 | 100.0 | 99.8 | 99.9 | 99.8 |

Motifs indicate the residues defining supertype specificites. The motifs incorporate residues determined on the basis of published data to be recognized by multiple alleles within the supertype. Residues within brackets are additional residues also predicted to be tolerated by multiple alleles within the supertype.

TABLE V

Frequently Occurring Motifs

| Name | avrg. % identity | Description | Potential Function |
|---|---|---|---|
| zf-C2H2 | 34% | Zinc finger, C2H2 type | Nucleic acid-binding protein functions as transcription factor, nuclear location probable |
| cytochrome_b_N | 68% | Cytochrome b(N-terminal)/b6/petB | membrane bound oxidase, generate superoxide |
| Ig | 19% | Immunoglobulin domain | domains are one hundred amino acids long and include a conserved intradomain disulfide bond. |
| WD40 | 18% | WD domain, G-beta repeat | tandem repeats of about 40 residues, each containing a Trp-Asp motif. Function in signal transduction and protein interaction |
| PDZ | 23% | PDZ domain | may function in targeting signaling molecules to sub-membranous sites |

TABLE V-continued

Frequently Occurring Motifs

| Name | avrg. % identity | Description | Potential Function |
|---|---|---|---|
| LRR | 28% | Leucine Rich Repeat | short sequence motifs involved in protein-protein interactions |
| Pkinase | 23% | Protein kinase domain | conserved catalytic core common to both serine/threonine and tyrosine protein kinases containing an ATP binding site and a catalytic site |
| PH | 16% | PH domain | pleckstrin homology involved in intracellular signaling or as constituents of the cytoskeleton |
| EGF | 34% | EGF-like domain | 30-40 amino-acid long found in the extracellular domain of membrane-bound proteins or in secreted proteins |
| Rvt | 49% | Reverse transcriptase (RNA-dependent DNA polymerase) | |
| Ank | 25% | Ank repeat | Cytoplasmic protein, associates integral membrane proteins to the cytoskeleton |
| Oxidored_q1 | 32% | NADH-Ubiquinone/plastoquinone (complex I), various chains | membrane associated. Involved in proton translocation across the membrane |
| Efhand | 24% | EF hand | calcium-binding domain, consists of a12 residue loop flanked on both sides by a 12 residue alpha-helical domain |
| Rvp | 79% | Retroviral aspartyl protease | Aspartyl or acid proteases, centered on a catalytic aspartyl residue |
| Collagen | 42% | Collagen triple helix repeat (20 copies) | extracellular structural proteins involved in formation of connective tissue. The sequence consists of the G-X-Y and the polypeptide chains forms a triple helix. |
| Fn3 | 20% | Fibronectin type III domain | Located in the extracellular ligand-binding region of receptors and is about 200 amino acid residues long with two pairs of cysteines involved in disulfide bonds |
| 7tm_1 | 19% | 7 transmembrane receptor (rhodopsin family) | seven hydrophobic transmembrane regions, with the N-terminus located extracellularly while the C-terminus is cytoplasmic. Signal through G proteins |

TABLE VI

Motif-bearing subsequences and Post-Translational Modifications of 158P3D2

Phosphorylation sites predicted:

| Pos. | Context | |
|---|---|---|
| Phosphoserine predictions | | |
| 73 | SRVFSLRPL | (SEQ ID NO: 107) |
| 107 | NLQVSPIQV | (SEQ ID NO: 108) |
| 128 | TGAWSEEDF | (SEQ ID NO: 109) |
| 173 | RLARSLGQQ | (SEQ ID NO: 110) |
| 206 | GVMFSPLKS | (SEQ ID NO: 111) |
| 210 | SPLKSRARA | (SEQ ID NO: 112) |
| 268 | QRGTSCPFY | (SEQ ID NO: 113) |
| 320 | LTPPSPKAF | (SEQ ID NO: 114) |
| 380 | KVTLSVRAR | (SEQ ID NO: 115) |
| 460 | YVRVSFLGQ | (SEQ ID NO: 116) |
| 469 | EGETSVSAE | (SEQ ID NO: 117) |
| 471 | ETSVSAEAA | (SEQ ID NO: 118) |
| 484 | NEQLSFVEL | (SEQ ID NO: 119) |
| 522 | LRRISHPGR | (SEQ ID NO: 120) |
| 624 | HLDASPGAE | (SEQ ID NO: 121) |
| 679 | SQPISFEIS | (SEQ ID NO: 122) |
| 683 | SFEISIGRA | (SEQ ID NO: 123) |
| 916 | DVLFSVVEE | (SEQ ID NO: 124) |
| 982 | GLPSSLHRD | (SEQ ID NO: 125) |
| 1012 | DSGLSDPFA | (SEQ ID NO: 126) |
| 1127 | ELDYSGRLE | (SEQ ID NO: 127) |
| 1136 | PSVPSEVEP | (SEQ ID NO: 128) |
| 1151 | VEPHSGRLS | (SEQ ID NO: 129) |
| 1155 | SGRLSLPPN | (SEQ ID NO: 130) |
| 1208 | EVLASYRES | (SEQ ID NO: 131) |
| 1212 | SYRESPNFT | (SEQ ID NO: 132) |
| 1380 | DPGDSDGVN | (SEQ ID NO: 133) |
| 1405 | KGTVSPKKA | (SEQ ID NO: 134) |
| 1419 | IYNRSLKEE | (SEQ ID NO: 135) |
| 1519 | YVVVSAGRE | (SEQ ID NO: 136) |
| 1585 | NRFYSHHRA | (SEQ ID NO: 137) |
| 1595 | CGLASQYEV | (SEQ ID NO: 138) |
| 1652 | LPPGSSSPT | (SEQ ID NO: 139) |
| 1654 | PGSSSPTVA | (SEQ ID NO: 140) |
| 1699 | YHPHSPGLL | (SEQ ID NO: 141) |
| 1733 | RQPISYELR | (SEQ ID NO: 142) |
| 1809 | EREVSVWRR | (SEQ ID NO: 143) |
| 1814 | VWRRSGPFA | (SEQ ID NO: 144) |
| 1841 | YDRISANDF | (SEQ ID NO: 145) |
| 1975 | LEKPSRPKT | (SEQ ID NO: 146) |
| Phosphothreonine predictions | | |
| 29 | FRGFTQKTR | (SEQ ID NO: 147) |
| 261 | QRRVTATQR | (SEQ ID NO: 148) |
| 263 | RVTATQRGT | (SEQ ID NO: 149) |
| 267 | TQRGTSCPF | (SEQ ID NO: 150) |
| 338 | TRIGTFRMD | (SEQ ID NO: 151) |
| 367 | DPRDTRAGT | (SEQ ID NO: 152) |
| 601 | LSRLTRKKK | (SEQ ID NO: 153) |

TABLE VI-continued

Motif-bearing subsequences and Post-Translational Modifications of 158P3D2 Phosphorylation sites predicted:

| | | |
|---|---|---|
| 613 | RRDQTPKAV | (SEQ ID NO: 154) |
| 704 | AGEGTEGAA | (SEQ ID NO: 155) |
| 828 | RRTMTRPNA | (SEQ ID NO: 156) |
| 1022 | VLISTQCQT | (SEQ ID NO: 157) |
| 1026 | TQCQTTRVL | (SEQ ID NO: 158) |
| 1033 | VLEQTLSPL | (SEQ ID NO: 159) |
| 1223 | VRHLTVVFK | (SEQ ID NO: 160) |
| 1412 | KAVATLKIY | (SEQ ID NO: 161) |
| 1527 | ERQDTKERY | (SEQ ID NO: 162) |
| 1557 | ETELTVAVF | (SEQ ID NO: 163) |
| 1643 | KVFLTPPET | (SEQ ID NO: 164) |
| 1743 | VIWNTEDVV | (SEQ ID NO: 165) |
| 1804 | DYLPTEREV | (SEQ ID NO: 166) |
| 1941 | VYILTGKVE | (SEQ ID NO: 167) |
| 1952 | FELLTVEEA | (SEQ ID NO: 168) |
| 1979 | SRPKTSFNW | (SEQ ID NO: 169) |

Phosphotyrosine predictions

| | | |
|---|---|---|
| 52 | RWPHYGAPL | (SEQ ID NO: 170) |
| 456 | LVEPYVRVS | (SEQ ID NO: 171) |
| 542 | WVPLYGSPP | (SEQ ID NO: 172) |
| 990 | DDFSYFQLR | (SEQ ID NO: 173) |
| 1095 | MEDPYQRPE | (SEQ ID NO: 174) |
| 1243 | PEQPYLQPP | (SEQ ID NO: 175) |
| 1515 | KADPYVVVS | (SEQ ID NO: 176) |
| 1531 | TKERYIPKQ | (SEQ ID NO: 177) |
| 1602 | EVDGYNAWR | (SEQ ID NO: 178) |
| 1629 | PAPEYRAGA | (SEQ ID NO: 179) |
| 1763 | SSDIYVKSW | (SEQ ID NO: 180) |

N-glycosylation sites

| | | |
|---|---|---|
| 67 | NCSR | (SEQ ID NO: 181) |
| 1214 | NFTE | (SEQ ID NO: 182) |
| 1417 | NRSL | (SEQ ID NO: 183) |

O-glycosylation sites

| | |
|---|---|
| 1403 | T |
| 1647 | T |
| 1656 | T |

Dileucine motifs

LL at 290
LL at 291
LL at 406
LL at 407
LL at 438
LL at 571
LL at 572
LL at 643
LL at 658
LL at 714
LL at 840
LL at 847
LL at 855
LL at 874
LL at 971
LL at 1041
LL at 1184
LL at 1320
LL at 1333
LL at 1491

C2 domains aa2-96
aa230-355
aa420-530
aa992-1100
aa1492-1591
aa1735-1865

Coiled-coil regions aa168-186
aa1895-1922

Interaction motifs and specific kinase phosphorylation sites
proteins interaction motif 2

| | |
|---|---|
| RRTMTRP | (SEQ ID NO: 184) |

FHA domain interaction motif 1, threonine phosphorylation is required

| | |
|---|---|
| TPKA | (SEQ ID NO: 185) |
| TEGA | (SEQ ID NO: 186) |
| TWRL | (SEQ ID NO: 187) |
| TSEL | (SEQ ID NO: 188) |
| TAPL | (SEQ ID NO: 189) |
| TLKI | (SEQ ID NO: 190) |
| TRPL | (SEQ ID NO: 191) |

Motif found in p53 family members which confers binding to the N-terminal domain of MDM2

| | |
|---|---|
| FGPAWVPL | (SEQ ID NO: 192) |

Class III PDZ domains binding motif

| | |
|---|---|
| DENL | (SEQ ID NO: 193) |
| FELI | (SEQ ID NO: 194) |
| RDSL | (SEQ ID NO: 195) |
| NEGV | (SEQ ID NO: 196) |
| VEEL | (SEQ ID NO: 197) |
| EELL | (SEQ ID NO: 198) |
| PENV | (SEQ ID NO: 199) |
| EDFL | (SEQ ID NO: 200) |
| EEQL | (SEQ ID NO: 201) |
| EEEL | (SEQ ID NO: 202) |
| AERL | (SEQ ID NO: 203) |
| VERL | (SEQ ID NO: 204) |
| LEVL | (SEQ ID NO: 205) |
| PDVL | (SEQ ID NO: 206) |
| QDVL | (SEQ ID NO: 207) |
| PDLL | (SEQ ID NO: 208) |
| GELI | (SEQ ID NO: 209) |
| VEVL | (SEQ ID NO: 210) |
| SEVL | (SEQ ID NO: 211) |
| TELV | (SEQ ID NO: 212) |
| EEDI | (SEQ ID NO: 213) |
| PEEL | (SEQ ID NO: 214) |
| SDGV | (SEQ ID NO: 215) |
| EDWL | (SEQ ID NO: 216) |
| SEAV | (SEQ ID NO: 217) |
| PETL | (SEQ ID NO: 218) |
| PEHV | (SEQ ID NO: 219) |
| PEDL | (SEQ ID NO: 220) |
| FELL | (SEQ ID NO: 221) |
| PEPL | (SEQ ID NO: 222) |

Src-family Src Homology 2 (SH2) domains binding motif.

| | |
|---|---|
| YQPP | (SEQ ID NO: 223) |

This is the motif recognized by class I SH3 domains

| | |
|---|---|
| RAEPEPP | (SEQ ID NO: 224) |
| RLEPSVP | (SEQ ID NO: 225) |

TABLE VI-continued

Motif-bearing subsequences and Post-Translational Modifications of 158P3D2 Phosphorylation sites predicted:

This is the motif recognized by those SH3 domains with a non-canonical class I recognition specificity

| | |
|---|---|
| LPPPMLP | (SEQ ID NO: 226) |
| PMLPPAP | (SEQ ID NO: 227) |
| RAEPEPP | (SEQ ID NO: 228) |
| AEGPEIP | (SEQ ID NO: 229) |
| PENVLAP | (SEQ ID NO: 230) |
| AEEPQPP | (SEQ ID NO: 231) |
| EPQPPLP | (SEQ ID NO: 232) |
| RLEPSVP | (SEQ ID NO: 233) |
| LLEVEQP | (SEQ ID NO: 234) |
| QDLPEQP | (SEQ ID NO: 235) |
| DMMPKGP | (SEQ ID NO: 236) |
| LYHPHSP | (SEQ ID NO: 237) |
| PQDVPAP | (SEQ ID NO: 238) |
| QDVPAPP | (SEQ ID NO: 239) |
| DIKPRQP | (SEQ ID NO: 240) |
| LEKPSRP | (SEQ ID NO: 241) |

This is the motif recognized by those SH3 domains with a non-canonical class II recognition specificity

| | |
|---|---|
| KPPLKKLP | (SEQ ID NO: 242) |

Major TRAF2-binding consensus motif. Members of the tumor necrosis factor receptor (TNFR) superfamily initiate intracellular signaling by recruiting the C-domain of the TNFR-associated factors (TRAFs) through their cytoplasmic tails.

| | |
|---|---|
| PEEE | (SEQ ID NO: 243) |
| PPEE | (SEQ ID NO: 244) |
| PEEE | (SEQ ID NO: 245) |
| SLQE | (SEQ ID NO: 246) |
| TVEE | (SEQ ID NO: 247) |

TRAF6 binding site. Members of the tumor necrosis factor (TNFR) superfamily initiate intracellular signaling by recruiting the C-domain of the TNFR-associated factors (TRAFs) through their cytoplasmatic tails.

| | |
|---|---|
| GVPAERPWA | (SEQ ID NO: 248) |
| ARPEEEKEE | (SEQ ID NO: 249) |
| DPPEEEGEM | (SEQ ID NO: 250) |
| PDPEELDWG | (SEQ ID NO: 251) |

PPLP is the motif recognized by WW domains of Group II

| | |
|---|---|
| PPLP | (SEQ ID NO: 252) |

GSK3 phosphorylation recognition site

| | |
|---|---|
| GATGAWS | (SEQ ID NO: 253) |
| MFSPLKS | (SEQ ID NO: 254) |
| RDTRAGT | (SEQ ID NO: 255) |
| VASQPIS | (SEQ ID NO: 256) |
| PISFEIS | (SEQ ID NO: 257) |
| IQSLMLT | (SEQ ID NO: 258) |
| PHSGRLS | (SEQ ID NO: 259) |
| LASYRES | (SEQ ID NO: 260) |
| RESPNFT | (SEQ ID NO: 261) |
| FLTPPET | (SEQ ID NO: 262) |
| PGSSSPT | (SEQ ID NO: 263) |
| KPSRPKT | (SEQ ID NO: 264) |

PKA phosphorylation site

RDT
RDS
RLT
RGS
RRT
RLS
RES
RFT

Site phosphorylated by the Polo-like-kinase

| | |
|---|---|
| EATM | (SEQ ID NO: 265) |
| DPTV | (SEQ ID NO: 266) |
| EISI | (SEQ ID NO: 267) |
| DHTW | (SEQ ID NO: 268) |
| EPSA | (SEQ ID NO: 269) |
| EPSV | (SEQ ID NO: 270) |

Proline-Directed Kinase (e.g. MAPK) phosphorylation site in higher eukaryotes.

| | |
|---|---|
| LQVSPIQ | (SEQ ID NO: 271) |
| VMFSPLK | (SEQ ID NO: 272) |
| LYGSPPG | (SEQ ID NO: 273) |
| RDQTPKA | (SEQ ID NO: 274) |
| LDASPGA | (SEQ ID NO: 275) |
| YRESPNF | (SEQ ID NO: 276) |
| GTVSPKK | (SEQ ID NO: 277) |
| VFLTPPE | (SEQ ID NO: 278) |
| GSSSPTV | (SEQ ID NO: 279) |
| HPHSPGL | (SEQ ID NO: 280) |

SH-PTP2 and phospholipase C-gamma Src Homology 2 (SH2) domains binding motif.

aa249-252
aa456-459
aa1515-1518

CK1 phosphorylation site aa1009-1012
aa234-237
aa484-487
aa760-763

CK2 phosphorylation site aa1804-1807

PKB Phosphorylation site aa1522-1528

TABLE VII

Search Peptides

158P3D2 v.1, 9-mers, 10-mers and 15-mers (SEQ ID NO: 281)

```
  MWIDIFPQDV PAPPPVDIKP RQPISYELRV VIWNTEDVVL DDENPLTGEM SSDIYVKSWV   60
  KGLEHDKQET DVHFNSLTGE GNFNWRFVFR FDYLPTEREV SVWRRSGPFA LEEAEFRQPA  120
  VLVLQVWDYD RISANDFLGS LELQLPDMVR GARGPELCSV QLARNGAGPR CNLFRCRRLR  180
```

TABLE VII-continued

Search Peptides

```
GWWPVVKLKE AEDVEREAQE AQAGKKKRKQ RRRKGRPEDL EFTDMGGNVY ILTGKVEAEF    240
ELLTVEEAEK RPVGKGRKQP EPLEKPSRPK TSFNWFVNPL KTFVFFIWRR YWRTLVLLLL    300
VLLTVFLLLV FYTIPGQISQ VIFRPLHK                                      328

158P3D2 v.2A, 9-mers, 10-mers and 15-mers
                                                   (SEQ ID NO: 282)
MDDPGDSDGV NLISMVGEIQ DQGEAEVKGT VSPKKAVATL KIYNRSLEEE FNHFEDWLNV     60
FPLYRGQGGQ DGGGEEEGSG HLVGKFKGSF LIYPESEAVL FSEPQISRGI PQNRPIKLLV    120
RVYVVKATNL APADPNGKAD PYVVVSAGRE RQDTKERYIP KQLNPIFGEI LELSISLPAE    180
TELTVAVFEH DLVGSDDLIG ETHIDLENRF YSHHRANCGL ASQYEVWVQQ GPQEPF        236
```

158P3D2 v.3
9-mers aa 95-111
PTEREVSVRRRSGPFAL                  (SEQ ID NO: 283)
10-mers aa 94-112
LPTEREVSVRRRSGPFALE                (SEQ ID NO: 284)
15-mers aa 89-117
FRFDYLPTEREVSVRRRSGPFALEEAEFR      (SEQ ID NO: 285)

158P3D2 v.4
9-mers aa 94-110
LPTEREVSIWRRSGPFA                  (SEQ ID NO: 286)
10-mers aa 93-111
YLPTEREVSIWRRSGPFAL                (SEQ ID NO: 287)
15-mers aa 88-116
VFRFDYLPTEREVSIWRRSGPFALEEAEF      (SEQ ID NO: 288)

158P3D2 v.5A (BCP2A) ORF: 849-1385
9-mers
LVLQVWDYTASLPMTSLDPWSCSYQTWCVGP    (SEQ ID NO: 289)
GAPSSALCSWPAMGPGRGAICFAAAA
10-mers
VLVLQVWDYTASLPMTSLDPWSCSYQTWCVGP   (SEQ ID NO: 290)
GAPSSALCSWPAMGPGRGAICFAAAA
15-mers
FRQPAVLVLQVWDYTASLPMTSLDPWSCSYQT   (SEQ ID NO: 291)
WCVGPGAPSSALCSWPAMGPGRGAICFAAAA 158P3D2 v.10
9-mers aa 50-66
MSSDIYVKRWVKGLEHD                  (SEQ ID NO: 292)
10-mers aa 49-67
EMSSDIYVKRWVKGLEHDK                (SEQ ID NO: 293)
15-mers aa 44-72
NPLTGEMSSDIYVKRWVKGLEHDKQETDV      (SEQ ID NO: 294)

158P3D2 v.12
9-mers aa 273-287
FNWFVNPLNTFVFFIWR                  (SEQ ID NO: 295)
10-mers aa 272-288
SFNWFVNPLNTFVFFIWRR                (SEQ ID NO: 296)
15-mers aa 267-293
SRPKTSFNWFVNPLNTFVFFIWRRYWRTL      (SEQ ID NO: 297)

158P3D2 v.13
9-mers aa 274-288
NWFVNPLKAFVFFIWRR                  (SEQ ID NO: 298)
10-mers aa 273-287
FNWFVNPLKAFVFFIWRRY                (SEQ ID NO: 299)
15-mers aa 268-294
RPKTSFNWFVNPLKAFVFFIWRRYWRTLV      (SEQ ID NO: 300)

Combination of v12 and v13
9-mers aa 273-287
NWFVNPLNAFVFFIWR                   (SEQ ID NO: 301)
10-mers aa 272-288
FNWFVNPLNAFVFFIWRR                 (SEQ ID NO: 302)
15-mers aa 267-293
RPKTSFNWFVNPLNAFVFFIWRRYWRTL       (SEQ ID NO: 303)

v.14 ORF: 65-4246 Frame +2
Part A
9-mers
ELVRHLTVDLPEQPYL                   (SEQ ID NO: 304)
10-mers
ELVRHLTVDLPEQPYLQ                  (SEQ ID NO: 305)
15-mers
ESPNFTELVRHLTVDLPEQPYLQPPLSI       (SEQ ID NO: 306)

TABLE VII-continued

Search Peptides

Part B
9-mers
MVGEIQDQDLQQVPEGRI                                (SEQ ID NO: 307)
10-mers
SMVGEIQDQDLQQVPEGRI                               (SEQ ID NO: 308)
15-mers
GVNLISMVGEIQDQDLQQVPEGRI                          (SEQ ID NO: 309)

v.15 ORF: 65-3502 Frame +2
Part A
9-mers
KLRFLAEEHNFDEDEM                                  (SEQ ID NO: 310)
10-mers
AKLRFLAEEHNFDEDEM                                 (SEQ ID NO: 311)
15-mers
AKKLLAKLRFLAEEHNFDEDEMDDPGDS                      (SEQ ID NO: 312)

Part B
9-mers
LVRVYVVKLRNLCKIQGHEDFCLFSAATNLAPAD                (SEQ ID NO: 313)
10-mers
LLVRVYVVKLRNLCKIQGHEDFCLFSAATNLAPADP              (SEQ ID NO: 314)
15-mers
NRPIKLLVRVYVVKLRNLCKIQGHEDFCLFSAATNL              (SEQ ID NO: 315)
APADPNGKAD Part C
9-mers
GLASQYEVWVQQGPQEPF                                (SEQ ID NO: 316)
10-mers
CGLASQYEVWVQQGPQEPF                               (SEQ ID NO: 317)
15-mers
HHRANCGLASQYEVWVQQGPQEPF                          (SEQ ID NO: 318)

v.16 ORF: 65-6037 Frame +2 1990 AA
Part A
9-mers
GSKVFLTPPETLPPVASGDPEEAQALLV                      (SEQ ID NO: 319)
10-mers
GSKVFLTPPETLPPVASGDPEEAQALLV                      (SEQ ID NO: 320)
15-mers
GSKVFLTPPETLPPVASGDPEEAQALLV                      (SEQ ID NO: 321)

Part B
9-mers
VKLKEAEDGKVEAEFE                                  (SEQ ID NO: 322)
10mers
VVKLKEAEDGKVEAEFEL                                (SEQ ID NO: 323)
15-mers
RGWWPVVKLKEAEDGKVEAEFELLTVEE                      (SEQ ID NO: 324)

v.17 ORF: 65-6175 Frame +2
9-mers, 10-mers and 15-mers
                                                        (SEQ ID NO: 325)
MALTVSVQRL TGLTGTHDRQ VKLTFRGFTQ KTRKIHCGPE ADIGELFRWP HYGAPLAGEC        60
LSVQVVNCSR VFSLRPLGTL VISLQQLQNA GHLVLREALV DENLQVSPIQ VELDLKYQPP       120
EGATGAWSEE DFGAPIQDSF ELIIPNVGFQ ELEPGEAQLE RRAVALGRRL ARSLGQQDDE       180
ENELELELEQ DLDDEPDVEL SGVMFSPLKS RARALAHGDP FQVSRAQDFQ VGVTVLEAQK       240
LVGVNINPYV AVQVGGQRRV TATQRGTSCP FYNEYFLFEF HDTRLRLQDL LLEITVSGVG       300
VTSVLQRRGD EKAAGLTPPS PKAFHSQTLP FMATRIGTFR MDLGIILDQP DGQFYQRWVP       360
LHDPRDTRAG TKGFIKVTLS VRARGDLPPP MLPPAPGHCS DIEKNLLLPR GVPAERPWAR       420
LRVRLYRAEG LPALRLGLLG SLVRALHDQR VLVEPYVRVS FLGQEGETSV SAEAAAPEWN       480
EQLSFVELFP PLTRSLRLQL RDDAPLVDAA LATHVPDLRR ISHPGRAAGF NPTFGPAWVP       540
LYGSPPGAGL RDSLQGLNEG VGQGIWFRGR LLLAVSMQVL EGRAEPEPPQ AQQGSTLSRL       600
TRKKKKKARR DQTPKAVPQH LDASPGAEGP EIPRAMEVEV EELLPLPENV LAPCEDFLLF       660
GVLFEATMID PTVASQPISF EISIGRAGRL EEQLGRGSRA GEGTEGAAVE AQPLLGARPE       720
EEKEEEELGT HAQRPEPMDG SGPYFCLPLC HCKPCMHVWS CWEDHTWRLQ SSNCVRKVAE       780
RLDQGLQEVE RLQRKPGPGA CAQLKQALEV LVAGSRQFCH GAERRTMTRP NALDRCRGKL       840
LVHSLNLLAK QGLRLLRGLR RRNVQKKVAL AKKLLAKLRF LAEEPQPPLP DVLVWMLSGQ       900
RRVAWARIPA QDVLFSVVEE ERGRDCGKIQ SLMLTAPGAA PGEVCAKLEL FLRLGLGKQA       960
KACTSELPPD LLPEPSAGLP SSLHRDDFSY FQLRAHLYQA RGVLAADDSG LSDPFARVLI      1020
STQCQTTRVL EQTLSPLWDE LLVFEQLIVD GRREHLQEEP PLVIINVFDH NKFGPPVFLG      1080
RALAAPRVKL MEDPYQRPEL QFFPLRKGPW AAGELIAAFQ LIELDYSGRL EPSVPSEVEP      1140
QDLAPLVEPH SGRLSLPPNV CPVLREFRVE VLFWGLRGLG RVHLLEVEQP QVVLEVAGQG      1200
VESEVLASYR ESPNFTELVR HLTVVFKDTA PLFHPQDLPE QPYLQPPLSI LVIERRAFGH      1260
TVLVGSHIVP HMLRFTFRGH EDPPEEEGEM EETGDMMPKG PQGQKSLDPF LAEAGISRQL      1320
LKPPLKKLPL GGLLNQGPGL EEDIPDPEEL DWGSKYYASL QELQGQHNFD EDEMDDPGDS      1380

TABLE VII-continued

Search Peptides

```
DGVNLISMVG EIQDQGEAEV KGTVSPKKAV ATLKIYNRSL KEEFNHFEDW LNVFPLYRGQ  1440
GGQDGGGEEE GSGHLVGKFK GSFLIYPESE AVLFSEPQIS RGIPQNRPIK LLVRVYVVKA  1500
TNLAPADPNG KADPYVVVSA GRERQDTKER YIPKQLNPIF GEILELSISL PAETELTVAV  1560
FDHDLVGSDD LIGETHIDLE NRFYSHHRAN CGLASQYEVD GYNAWRDAFW PSQILAGLCQ  1620
RCGLPAPEYR AGAVKVGSKV FLTPPETLPP GSSSPTVASG DPEEAQALLV LRRWQEMPGF  1680
GIQLVPEHVE TRPLYHPSP GLLQGSLHMW IDIFPQDVPA PPPVDIKPRQ PISYELRVVI  1740
WNTEDVVLDD ENPLTGEMSS DIYVKSWVKG LEHDKQETDV HFNSLTGEGN FNWRFVFRFD  1800
YLPTEREVSV WRRSGPFALE EAEFRQPAVL VLQVWDYDRI SANDFLGSLE LQLPDMVRGA  1860
RGPELCSVQL ARNGAGPRCN LFRCRRLRGW WPVVKLKEAE DVEREAQEAQ AGKKKRKQRR  1920
RKGRPEDLEF TDMGGNVYIL TGKVEAEFEL LTVEEAEKRP VGKGRKQPEP LEKPSRPKTS  1980
FNWFVNPLKT FVFFIWRRYW RTLVLLLLVL LTVFLLLVFY TIPGQISQVI FRPLHK     2036
``` v.18 ORF: 2932-4764 Frame +1 610 aa
Part A
9-mers
MCKRRWHWPRSSWQNCAFWLRRHPGQPLVRSVPSWS         (SEQ ID NO: 326)
SSCGWAWASKPRPAPLSCPRICCPSPQPGCPPAYTG
TVLEQTLSP 10-mers
MCKRRWHWPRSSWQNCAFWLRRHPGQPLVRSVPSWS         (SEQ ID NO: 327)
SSCGWAWASKPRPAPLSCPRICCPSPQPGCPPAYTG
TVLEQTLSPL 15-mers
MCKRRWHWPRSSWQNCAFWLRRHPGQPLVRSVPSWS         (SEQ ID NO: 328)
SSCGWAWASKPRPAPLSCPRICCPSPQPGCPPAYTG
TVLEQTLSPLWDELL Part B
9-mers
GISRQLLKHNFDEDEM                             (SEQ ID NO: 329)
10-mers
AGISRQLLKHNFDEDEMD                           (SEQ ID NO: 330)
15-mers
PFLAEAGISRQLLKHNFDEDEMDDPGDS                 (SEQ ID NO: 331)

Part C
9-mers
GLASQYEVWVQQGPQEPF                           (SEQ ID NO: 332)
10-mers
CGLASQYEVWVQQGPQEPF                          (SEQ ID NO: 333)
15-mers
HHRANCGLASQYEVWVQQGPQEPF                     (SEQ ID NO: 334)

TABLE VIII

158P3D2v.1-A1-9-mers
Each peptide is a portion of
SEQ ID NO: 3; each start position
is Specified, the length of
the peptide is 9 amino acids and
the end position for each peptide
is the start position plus eight.

| Pos | Subsequence | Score |
|---|---|---|
| 222 | FTDMGGNVY | 62.500 |
| 47 | TGEMSSDIY | 11.250 |
| 219 | DLEFTDMGG | 4.500 |
| 110 | ALEEAEFRQ | 4.500 |
| 237 | EAEFELLTV | 4.500 |
| 247 | EAEKRPVGK | 3.600 |
| 198 | AQEAQAGKK | 2.700 |
| 78 | TGEGNFNWR | 2.250 |
| 259 | QPEPLEKPS | 2.250 |
| 113 | EAEFRQPAV | 1.800 |
| 140 | SLELQLPDM | 1.800 |
| 281 | KTFVFFIWR | 1.250 |
| 303 | LTVFLLLVF | 1.250 |
| 145 | LPDMVRGAR | 1.250 |
| 312 | YTIPGQISQ | 1.250 |
| 69 | ETDVHFNSL | 1.250 |
| 34 | NTEDVVLDD | 1.125 |
| 320 | QVIFRPLHK | 1.000 |
| 166 | GAGPRCNLF | 1.000 |
| 304 | TVFLLLVFY | 1.000 |

TABLE VIII-continued

158P3D2v.1-A1-9-mers
Each peptide is a portion of
SEQ ID NO: 3; each start position
is Specified, the length of
the peptide is 9 amino acids and
the end position for each peptide
is the start position plus eight.

| Pos | Subsequence | Score |
|-----|-------------|-------|
| 39  | VLDDENPLT   | 1.000 |
| 188 | LKEAEDVER   | 0.900 |
| 235 | KVEAEFELL   | 0.900 |
| 190 | EAEDVEREA   | 0.900 |
| 62  | GLEHDKQET   | 0.900 |
| 51  | SSDIYVKSW   | 0.750 |
| 2   | WIDIFPQDV   | 0.500 |
| 257 | RKQPEPLEK   | 0.500 |
| 142 | ELQLPDMVR   | 0.500 |
| 283 | FVFFIWRRY   | 0.500 |
| 121 | VLVLQVWDY   | 0.500 |
| 156 | ELCSVQLAR   | 0.500 |
| 154 | GPELCSVQL   | 0.450 |
| 97  | EREVSVWRR   | 0.450 |
| 242 | LLTVEEAEK   | 0.400 |
| 197 | EAQEAQAGK   | 0.400 |
| 243 | LTVEEAEKR   | 0.250 |
| 90  | RFDYLPTER   | 0.250 |
| 49  | EMSSDIYVK   | 0.200 |
| 4   | DIFPQDVPA   | 0.200 |
| 11  | PAPPPVDIK   | 0.200 |
| 123 | VLQVWDYDR   | 0.200 |
| 53  | DIYVKSWVK   | 0.200 |
| 262 | PLEKPSRPK   | 0.180 |
| 75  | NSLTGEGNF   | 0.150 |
| 67  | KQETDVHFN   | 0.135 |
| 126 | VWDYDRISA   | 0.125 |
| 293 | RTLVLLLLV   | 0.125 |
| 81  | GNFNWRFVF   | 0.125 |
| 277 | VNPLKTFVF   | 0.125 |
| 77  | LTGEGNFNW   | 0.125 |
| 214 | KGRPEDLEF   | 0.125 |
| 270 | KTSFNWFVN   | 0.125 |
| 85  | WRFVRFDY    | 0.125 |
| 40  | LDDENPLTG   | 0.125 |
| 216 | RPEDLEFTD   | 0.113 |
| 298 | LLLVLLTVF   | 0.100 |
| 200 | EAQAGKKKR   | 0.100 |
| 170 | RCNLFRCRR   | 0.100 |
| 109 | FALEEAEFR   | 0.100 |
| 276 | FVNPLKTFV   | 0.100 |
| 244 | TVEEAEKRP   | 0.090 |
| 25  | SYELRVVIW   | 0.090 |
| 193 | DVEREAQEA   | 0.090 |
| 195 | EREAQEAQA   | 0.090 |
| 132 | ISANDFLGS   | 0.075 |
| 316 | GQISQVIFR   | 0.075 |
| 105 | RSGPFALEE   | 0.075 |
| 10  | VPAPPPVDI   | 0.050 |
| 71  | DVHFNSLTG   | 0.050 |
| 300 | LVLLTVFLL   | 0.050 |
| 137 | FLGSLELQL   | 0.050 |
| 232 | LTGKVEAEF   | 0.050 |
| 294 | TLVLLLLVL   | 0.050 |
| 301 | VLLTVFLLL   | 0.050 |
| 302 | LLTVFLLLV   | 0.050 |
| 227 | GNVYILTGK   | 0.050 |
| 297 | LLLLVLLTV   | 0.050 |
| 296 | VLLLLVLLT   | 0.050 |
| 131 | RISANDFLG   | 0.050 |
| 308 | LLVFYTIPG   | 0.050 |
| 245 | VEEAEKRPV   | 0.045 |
| 143 | LQLPDMVRG   | 0.030 |
| 24  | ISYELRVVI   | 0.030 |
| 201 | AQAGKKKRK   | 0.030 |
| 50  | MSSDIYVKS   | 0.030 |
| 116 | FRQPAVLVL   | 0.025 |
| 46  | LTGEMSSDI   | 0.025 |
| 191 | AEDVEREAQ   | 0.025 |
| 95  | PTEREVSVW   | 0.022 |

TABLE VIII-continued

158P3D2v.1-A1-9-mers
Each peptide is a portion of
SEQ ID NO: 3; each start position
is Specified, the length of
the peptide is 9 amino acids and
the end position for each peptide
is the start position plus eight.

| Pos | Subsequence | Score |
|---|---|---|
| 59 | WVKGLEHDK | 0.020 |
| 179 | LRGWWPVVK | 0.020 |
| 306 | FLLLVFYTI | 0.020 |
| 157 | LCSVQLARN | 0.020 |
| 230 | YILTGKVEA | 0.020 |
| 309 | LVFYTIPGQ | 0.020 |
| 299 | LLVLLTVFL | 0.020 |
| 17 | DIKPRQPIS | 0.020 |
| 295 | LVLLLLVLL | 0.020 |
| 158 | CSVQLARNG | 0.015 |

TABLE IX

158P3D2v.1-A1-10-mers
Each peptide is a portion of
SEQ ID NO: 3; each start position
is Specified, the length of
the peptide is 10 amino acids and
the end position for each peptide
is the start position plus nine.

| Pos | Subsequence | Score |
|---|---|---|
| 259 | QPEPlEKPSR | 45.000 |
| 276 | FVNPlKTFVF | 5.000 |
| 166 | GAGPrCNLFR | 5.000 |
| 235 | KVEAeFELLT | 4.500 |
| 198 | AQEAqAGKKK | 2.700 |
| 39 | VLDDeNPLTG | 2.500 |
| 303 | LTVFlLLVFY | 2.500 |
| 17 | DIKPrQPISY | 2.500 |
| 222 | FTDMgGNVYI | 2.500 |
| 78 | TGEGnFNWRF | 2.250 |
| 113 | EAEFrQPAVL | 1.800 |
| 46 | LTGEmSSDIY | 1.250 |
| 69 | ETDVhFNSLT | 1.250 |
| 47 | TGEMsSDIYV | 1.125 |
| 140 | SLELqLPDMV | 0.900 |
| 219 | DLEFtDMGGN | 0.900 |
| 190 | EAEDvEREAQ | 0.900 |
| 244 | TVEEaEKRPV | 0.900 |

TABLE IX-continued

158P3D2v.1-A1-10-mers
Each peptide is a portion of
SEQ ID NO: 3; each start position
is Specified, the length of
the peptide is 10 amino acids and
the end position for each peptide
is the start position plus nine.

| Pos | Subsequence | Score |
|---|---|---|
| 51 | SSDIyVKSWV | 0.750 |
| 67 | KQETdVHFNS | 0.675 |
| 134 | ANDFlGSLEL | 0.625 |
| 120 | AVLVlQVWDY | 0.500 |
| 302 | LLTVfLLLVF | 0.500 |
| 10 | VPAPpPVDIK | 0.500 |
| 95 | PTEReVSVWR | 0.450 |
| 241 | ELLTvEEAEK | 0.400 |
| 312 | YTIPgQISQV | 0.250 |
| 281 | KTFVfFIWRR | 0.250 |
| 145 | LPDMvRGARG | 0.250 |
| 77 | LTGEgNFNWR | 0.250 |
| 12 | APPPvDIKPR | 0.250 |
| 154 | GPELcSVQLA | 0.225 |
| 216 | RPEDlEFTDM | 0.225 |
| 34 | NTEDvVLDDE | 0.225 |
| 25 | SYELrVVIWN | 0.225 |
| 122 | LVLQvWDYDR | 0.200 |
| 231 | ILTGkVEAEF | 0.200 |
| 197 | EAQEaQAGKK | 0.200 |
| 200 | EAQAgKKKRK | 0.200 |
| 100 | VSVWrRSGPF | 0.150 |
| 105 | RSGPfALEEA | 0.150 |
| 319 | SQVIfRPLHK | 0.150 |
| 80 | EGNFnWRFVF | 0.125 |
| 293 | RTLVlLLLVL | 0.125 |
| 297 | LLLLvLLTVF | 0.100 |
| 144 | QLPDmVRGAR | 0.100 |
| 242 | LLTVeEAEKR | 0.100 |
| 193 | DVEReAQEAQ | 0.090 |
| 247 | EAEKrPVGKG | 0.090 |
| 62 | GLEHdKQETD | 0.090 |
| 245 | VEEAeKRPVG | 0.090 |
| 110 | ALEEaEFRQP | 0.090 |
| 237 | EAEFeLLTVE | 0.090 |

TABLE IX-continued

158P3D2v.1-A1-10-mers
Each peptide is a portion of SEQ ID NO: 3; each start position is Specified, the length of the peptide is 10 amino acids and the end position for each peptide is the start position plus nine.

| Pos | Subsequence | Score |
|---|---|---|
| 107 | GPFA1EEAEF | 0.050 |
| 15 | PVDIkPRQPI | 0.050 |
| 304 | TVFL1LVFYT | 0.050 |
| 2 | WIDIfPQDVP | 0.050 |
| 76 | SLTGeGNFNW | 0.050 |
| 307 | LLLVfYTIPG | 0.050 |
| 300 | LVLLtVFLLL | 0.050 |
| 295 | LVLL1LVLLT | 0.050 |
| 301 | VLLTvFLLLV | 0.050 |
| 299 | LLVL1TVFLL | 0.050 |
| 261 | EPLEkPSRPK | 0.050 |
| 277 | VNPLkTFVFF | 0.050 |
| 109 | FALEeAEFRQ | 0.050 |
| 81 | GNFNwRFVFR | 0.050 |
| 296 | VLLL1VLLTV | 0.050 |
| 314 | IPGQISQVIF | 0.050 |
| 226 | GGNVyILTGK | 0.050 |
| 131 | RISAnDFLGS | 0.050 |
| 97 | EREVsVWRRS | 0.045 |
| 239 | EFEL1TVEEA | 0.045 |
| 111 | LEEAeFRQPA | 0.045 |
| 41 | DDENpLTGEM | 0.045 |
| 195 | EREAqEAQAG | 0.045 |
| 178 | RLRGwWPVVK | 0.040 |
| 24 | ISYE1RVVIW | 0.030 |
| 139 | GSLE1QLPDM | 0.030 |
| 318 | ISQViFRPLH | 0.030 |
| 224 | DMGGnVYILT | 0.025 |
| 165 | NGAGpRCNLF | 0.025 |
| 282 | TFVFfIWRRY | 0.025 |
| 280 | LKTFvFFIWR | 0.025 |
| 82 | NFNWrFVFRF | 0.025 |
| 171 | CNLFrCRRLR | 0.025 |
| 126 | VWDYdRISAN | 0.025 |
| 128 | DYDRiSANDF | 0.025 |

TABLE IX-continued

158P3D2v.1-A1-10-mers
Each peptide is a portion of SEQ ID NO: 3; each start position is Specified, the length of the peptide is 10 amino acids and the end position for each peptide is the start position plus nine.

| Pos | Subsequence | Score |
|---|---|---|
| 141 | LELQ1PDMVR | 0.025 |
| 35 | TEDVvLDDEN | 0.025 |
| 74 | FNSLtGEGNF | 0.025 |
| 221 | EFTDmGGNVY | 0.025 |
| 294 | TLVL1LLVLL | 0.020 |
| 38 | VVLDdENPLT | 0.020 |
| 142 | ELQLpDMVRG | 0.020 |
| 53 | DIYVkSWVKG | 0.020 |
| 246 | EEAEkRPVGK | 0.020 |
| 187 | KLKEaEDVER | 0.020 |
| 272 | SFNWfVNPLK | 0.020 |
| 298 | LLLV1LTVFL | 0.020 |

TABLE X

158P3D2v.1-A0201-9-mers
Each peptide is a portion of SEQ ID NO: 3; each start position is Specified, the length of the peptide is 9 amino acids and the end position for each peptide is the start position plus eight.

| Pos | Subsequence | Score |
|---|---|---|
| 302 | LLTVFLLLV | 1033.404 |
| 297 | LLLLVLLTV | 1006.209 |
| 286 | FIWRRYWRT | 440.113 |
| 306 | FLLLVFYTI | 337.376 |
| 301 | VLLTVFLLL | 255.302 |
| 299 | LLVLLTVFL | 199.738 |
| 300 | LVLLTVFLL | 156.843 |
| 276 | FVNPLKTFV | 153.971 |
| 296 | VLLLLVLLT | 107.808 |
| 137 | FLGSLELQL | 98.267 |
| 2 | WIDIFPQDV | 66.867 |
| 38 | VVLDDENPL | 48.205 |
| 48 | GEMSSDIYV | 27.521 |
| 31 | VIWNTEDVV | 27.109 |
| 295 | LVLLLLVLL | 27.042 |
| 313 | TIPGQISQV | 21.996 |

TABLE X-continued

158P3D2v.1-A0201-9-mers
Each peptide is a portion of SEQ ID NO: 3; each start position is Specified, the length of the peptide is 9 amino acids and the end position for each peptide is the start position plus eight.

| Pos | Subsequence | Score |
|---|---|---|
| 39 | VLDDENPLT | 20.776 |
| 294 | TLVLLLLVL | 20.145 |
| 230 | YILTGKVEA | 11.626 |
| 144 | QLPDMVRGA | 9.370 |
| 293 | RTLVLLLLV | 8.221 |
| 30 | VVIWNTEDV | 5.069 |
| 141 | LELQLPDMV | 4.168 |
| 236 | VEAEFELLT | 3.838 |
| 178 | RLRGWWPVV | 3.684 |
| 94 | LPTEREVSV | 3.165 |
| 180 | RGWWPVVKL | 2.662 |
| 228 | NVYILTGKV | 2.532 |
| 305 | VFLLLVFYT | 2.388 |
| 279 | PLKTFVFFT | 2.240 |
| 121 | VLVLQVWDY | 2.185 |
| 240 | FELLTVEEA | 1.853 |
| 133 | SANDFLGSL | 1.382 |
| 124 | LQVWDYDRI | 1.322 |
| 224 | DMGGNVYIL | 1.091 |
| 118 | QPAVLVLQV | 1.044 |
| 46 | LTGEMSSDI | 1.010 |
| 83 | FNWRFVFRF | 0.941 |
| 27 | ELRVVIWNT | 0.733 |
| 140 | SLELQLPDM | 0.731 |
| 234 | GKVEAEFEL | 0.706 |
| 55 | YVKSWVKGL | 0.692 |
| 114 | AEFRQPAVL | 0.630 |
| 24 | ISYELRVVI | 0.623 |
| 52 | SDIYVKSWV | 0.531 |
| 62 | GLEHDKQET | 0.477 |
| 177 | RRLRGWWPV | 0.456 |
| 22 | QPISYELRV | 0.454 |
| 298 | LLLVLLTVF | 0.442 |
| 159 | SVQLARNGA | 0.435 |
| 76 | SLTGEGNFN | 0.410 |
| 235 | KVEAEFELL | 0.390 |
| 183 | WPVVKLKEA | 0.343 |
| 269 | PKTSFNWFV | 0.333 |
| 26 | YELRVVIWN | 0.312 |
| 304 | TVFLLLVFY | 0.305 |
| 186 | VKLKEAEDV | 0.298 |
| 223 | TDMGGNVYI | 0.295 |
| 307 | LLLVFYTIP | 0.219 |
| 4 | DIFPQDVPA | 0.190 |
| 165 | NGAGPRCNL | 0.139 |
| 272 | SFNWFVNPL | 0.130 |
| 308 | LLVFYTIPG | 0.127 |
| 225 | MGGNVYILT | 0.124 |
| 10 | VPAPPPVDI | 0.116 |
| 112 | EEAEFRQPA | 0.113 |
| 135 | NDFLGSLEL | 0.110 |
| 143 | LQLPDMVRG | 0.109 |
| 281 | KTFVFFIWR | 0.106 |
| 171 | CNLFRCRRL | 0.103 |
| 8 | QDVPAPPPV | 0.097 |
| 318 | ISQVIFRPL | 0.090 |
| 87 | FVFRFDYLP | 0.084 |
| 86 | RFVFRFDYL | 0.076 |
| 93 | YLPTEREVS | 0.069 |
| 80 | EGNFNWRFV | 0.064 |
| 131 | RISANDFLG | 0.059 |
| 290 | RYWRTLVLL | 0.057 |
| 314 | IPGQISQVI | 0.047 |
| 77 | LTGEGNFNW | 0.042 |
| 79 | GEGNFNWRF | 0.041 |
| 23 | PISYELRVV | 0.040 |
| 70 | TDVHFNSLT | 0.039 |
| 109 | FALEEAEFR | 0.039 |
| 283 | FVFFIWRRY | 0.038 |
| 122 | LVLQVWDYD | 0.038 |
| 106 | SGPFALEEA | 0.037 |

TABLE X-continued

158P3D2v.1-A0201-9-mers
Each peptide is a portion of SEQ ID NO: 3; each start position is Specified, the length of the peptide is 9 amino acids and the end position for each peptide is the start position plus eight.

| Pos | Subsequence | Score |
|---|---|---|
| 68 | QETDVHFNS | 0.034 |
| 168 | GPRCNLFRC | 0.033 |
| 292 | WRTLVLLLL | 0.031 |
| 245 | VEEAEKRPV | 0.029 |
| 319 | SQVIFRPLH | 0.029 |
| 231 | ILTGKVEAE | 0.029 |
| 317 | QISQVIFRP | 0.027 |
| 120 | AVLVLQVWD | 0.027 |
| 215 | GRPEDLEFT | 0.026 |
| 242 | LLTVEEAEK | 0.025 |
| 123 | VLQVWDYDR | 0.025 |
| 16 | VDIKPRQPI | 0.025 |
| 258 | KQPEPLEKP | 0.024 |

TABLE XI

158P3D2v.1-A0201-10-mers
Each peptide is a portion of SEQ ID NO: 3; each start position is Specified, the length of the peptide is 10 amino acids and the end position for each peptide is the start position plus nine.

| Pos | Subsequence | Score |
|---|---|---|
| 301 | VLLTvFLLLV | 3823.593 |
| 296 | VLLLlVLLTV | 1006.209 |
| 298 | LLLVlLTVFL | 739.032 |
| 299 | LLVLlTVFLL | 484.457 |
| 93 | YLPTeREVSV | 319.939 |
| 304 | TVFLlLVFYT | 177.011 |
| 278 | NPLKtFVFFI | 70.254 |
| 294 | TLVLlLLVLL | 49.134 |
| 26 | YELRvVIWNT | 42.542 |
| 286 | FIWRrYWRTL | 38.130 |
| 300 | LVLLtVFLLL | 22.339 |
| 236 | VEAEfELLTV | 21.680 |
| 101 | SVWRrSGPFA | 19.844 |
| 31 | VIWNtEDVVL | 16.993 |
| 38 | VVLDdENPLT | 16.816 |

TABLE XI-continued

158P3D2v.1-A0201-10-mers
Each peptide is a portion of SEQ ID NO: 3; each start position is Specified, the length of the peptide is 10 amino acids and the end position for each peptide is the start position plus nine.

| Pos | Subsequence | Score |
|---|---|---|
| 87 | FVFRfDYLPT | 16.647 |
| 117 | RQPAvLVLQV | 16.219 |
| 125 | QVWDyDRISA | 14.793 |
| 123 | VLQVwDYDRI | 13.036 |
| 312 | YTIPgQISQV | 10.220 |
| 295 | LVLLlLVLLT | 9.433 |
| 63 | LEHDkQETDV | 9.426 |
| 21 | RQPIsYELRV | 7.052 |
| 114 | AEFRqPAVLV | 5.004 |
| 271 | TSFNwFVNPL | 4.510 |
| 68 | QETDvHFNSL | 3.236 |
| 29 | RVVIwNTEDV | 2.982 |
| 61 | KGLEhDKQET | 2.583 |
| 79 | GEGNfNWRFV | 2.529 |
| 268 | RPKTsFNWFV | 2.491 |
| 140 | SLELqLPDMV | 2.181 |
| 30 | VVIWnTEDVV | 2.078 |
| 273 | FNWFvNPLKT | 1.857 |
| 222 | FTDMgGNVYI | 1.466 |
| 143 | LQLPdMVRGA | 1.457 |
| 275 | WFVNpLKTFV | 1.222 |
| 139 | GSLElQLPDM | 1.132 |
| 317 | QISQvIFRPL | 1.116 |
| 220 | LEFTdMGGNV | 1.106 |
| 293 | RTLVlLLLVL | 1.035 |
| 51 | SSDIyVKSWV | 0.999 |
| 309 | LVFYtIPGQI | 0.746 |
| 224 | DMGGnVYILT | 0.605 |
| 306 | FLLLvFYTIP | 0.593 |
| 313 | TIPGqISQVI | 0.588 |
| 153 | RGPElCSVQL | 0.572 |
| 235 | KVEAeFELLT | 0.555 |
| 307 | LLLVfYTIPG | 0.469 |
| 297 | LLLLvLLTVF | 0.442 |
| 167 | AGPRcNLFRC | 0.433 |
| 76 | SLTGeGNFNW | 0.432 |

TABLE XI-continued

158P3D2v.1-A0201-10-mers
Each peptide is a portion of SEQ ID NO: 3; each start position is Specified, the length of the peptide is 10 amino acids and the end position for each peptide is the start position plus nine.

| Pos | Subsequence | Score |
|---|---|---|
| 120 | AVLVlQVWDY | 0.416 |
| 112 | EEAEfRQPAV | 0.416 |
| 244 | TVEEaEKRPV | 0.319 |
| 91 | FDYLpTEREV | 0.284 |
| 189 | KEAEdVEREA | 0.277 |
| 172 | NLFRcRRLRG | 0.276 |
| 132 | ISANdFLGSL | 0.269 |
| 285 | FFIWrRYWRT | 0.268 |
| 85 | WRFVfRFDYL | 0.259 |
| 1 | MWIDIFPQDV | 0.256 |
| 148 | MVRGaRGPEL | 0.242 |
| 45 | PLTGeMSSDI | 0.230 |
| 39 | VLDDeNPLTG | 0.208 |
| 185 | VVKLkEAEDV | 0.177 |
| 281 | KTFVfFIWRR | 0.176 |
| 151 | GARGpELCSV | 0.169 |
| 47 | TGEMsSDIYV | 0.160 |
| 137 | FLGSlELQLP | 0.158 |
| 37 | DVVLdDENPL | 0.140 |
| 164 | RNGAgPRCNL | 0.139 |
| 231 | ILTGkVEAEF | 0.127 |
| 283 | FVFFIWRRYW | 0.122 |
| 302 | LLTVfLLLVF | 0.119 |
| 121 | VLVLqVWDYD | 0.116 |
| 234 | GKVEaEFELL | 0.113 |
| 258 | KQPEpLEKPS | 0.108 |
| 223 | TDMGgNVYIL | 0.104 |
| 292 | WRTLvLLLLV | 0.102 |
| 305 | VFLLlVFYTI | 0.087 |
| 22 | QPISyELRVV | 0.086 |
| 109 | FALEeAEFRQ | 0.084 |
| 214 | KGRPeDLEFT | 0.080 |
| 276 | FVNPlKTFVF | 0.071 |
| 9 | DVPApPPVDI | 0.068 |
| 7 | PQDVpAPPPV | 0.062 |

TABLE XI-continued

158P3D2v.1-A0201-10-mers
Each peptide is a portion of SEQ ID NO: 3; each start position is Specified, the length of the peptide is 10 amino acids and the end position for each peptide is the start position plus nine.

| Pos | Subsequence | Score |
|---|---|---|
| 227 | GNVYILTGKV | 0.059 |
| 308 | LLVFyTIPGQ | 0.058 |
| 290 | RYWRtLVLLL | 0.057 |
| 134 | ANDFlGSLEL | 0.056 |
| 194 | VEREaQEAQA | 0.051 |
| 111 | LEEAeFRQPA | 0.040 |
| 230 | YILTgKVEAE | 0.039 |
| 19 | KPRQpISYEL | 0.037 |
| 105 | RSGPfALEEA | 0.037 |
| 158 | CSVQlARNGA | 0.032 |
| 233 | TGKVeAEFEL | 0.028 |
| 129 | YDRIsANDFL | 0.028 |
| 170 | RCNLfRCRRL | 0.028 |
| 177 | RRLRgWWPVV | 0.025 |

TABLE XII

158P3D2v.1-A3-9-mers
Each peptide is a portion of SEQ ID NO: 3; each start position is Specified, the length of the peptide is 9 amino acids and the end position for each peptide is the start position plus eight.

| Pos | Subsequence | Score |
|---|---|---|
| 281 | KTFVFFIWR | 54.000 |
| 121 | VLVLQVWDY | 54.000 |
| 123 | VLQVWDYDR | 36.000 |
| 49 | EMSSDIYVK | 27.000 |
| 242 | LLTVEEAEK | 20.000 |
| 306 | FLLLVFYTI | 12.150 |
| 53 | DIYVKSWVK | 9.000 |
| 301 | VLLTVFLLL | 8.100 |
| 320 | QVIFRPLHK | 6.000 |
| 298 | LLLVLLTVF | 4.500 |
| 142 | ELQLPDMVR | 3.600 |
| 156 | ELCSVQLAR | 3.600 |
| 316 | GQISQVIFR | 3.240 |
| 59 | WVKGLEHDK | 3.000 |
| 304 | TVFLLLVFY | 3.000 |

TABLE XII-continued

158P3D2v.1-A3-9-mers
Each peptide is a portion of SEQ ID NO: 3; each start position is Specified, the length of the peptide is 9 amino acids and the end position for each peptide is the start position plus eight.

| Pos | Subsequence | Score |
|---|---|---|
| 294 | TLVLLLLVL | 2.700 |
| 224 | DMGGNVYIL | 2.430 |
| 172 | NLFRCRRLR | 2.000 |
| 302 | LLTVFLLLV | 1.800 |
| 279 | PLKTFVFFI | 1.620 |
| 297 | LLLLVLLTV | 1.350 |
| 137 | FLGSLELQL | 1.200 |
| 181 | GWWPVVKLK | 1.013 |
| 299 | LLVLLTVFL | 0.900 |
| 296 | VLLLLVLLT | 0.900 |
| 178 | RLRGWWPVV | 0.900 |
| 300 | LVLLTVFLL | 0.810 |
| 81 | GNFNWRFVF | 0.540 |
| 235 | KVEAEFELL | 0.540 |
| 83 | FNWRFVFRF | 0.540 |
| 303 | LTVFLLLVF | 0.450 |
| 243 | LTVEEAEKR | 0.450 |
| 201 | AQAGKKKRK | 0.450 |
| 227 | GNVYILTGK | 0.405 |
| 62 | GLEHDKQET | 0.300 |
| 273 | FNWFVNPLK | 0.300 |
| 262 | PLEKPSRPK | 0.300 |
| 283 | FVFFIWRRY | 0.300 |
| 101 | SVWRRSGPF | 0.300 |
| 140 | SLELQLPDM | 0.300 |
| 55 | YVKSWVKGL | 0.270 |
| 27 | ELRVVIWNT | 0.203 |
| 222 | FTDMGGNVY | 0.200 |
| 85 | WRFVFRFDY | 0.180 |
| 308 | LLVFYTIPG | 0.180 |
| 198 | AQEAQAGKK | 0.180 |
| 79 | GEGNFNWRF | 0.162 |
| 286 | FIWRRYWRT | 0.150 |
| 232 | LTGKVEAEF | 0.150 |
| 295 | LVLLLLVLL | 0.135 |
| 11 | PAPPPVDIK | 0.135 |
| 21 | RQPISYELR | 0.120 |
| 170 | RCNLFRCRR | 0.120 |
| 31 | VIWNTEDVV | 0.100 |
| 39 | VLDDENPLT | 0.100 |
| 278 | NPLKTFVFF | 0.090 |
| 187 | KLKEAEDVE | 0.090 |
| 231 | ILTGKVEAE | 0.090 |
| 265 | KPSRPKTSF | 0.090 |
| 87 | FVFRFDYLP | 0.090 |
| 110 | ALEEAEFRQ | 0.090 |
| 307 | LLLVFYTIP | 0.090 |
| 38 | VVLDDENPL | 0.090 |
| 166 | GAGPRCNLF | 0.090 |
| 109 | FALEEAEFR | 0.090 |
| 197 | EAQEAQAGK | 0.090 |
| 282 | TFVFFIWRR | 0.081 |
| 179 | LRGWWPVVK | 0.060 |
| 257 | RKQPEPLEK | 0.060 |
| 144 | QLPDMVRGA | 0.060 |
| 268 | RPKTSFNWF | 0.060 |
| 247 | EAEKRPVGK | 0.060 |
| 2 | WIDIFPQDV | 0.060 |
| 46 | LTGEMSSDI | 0.045 |
| 293 | RTLVLLLLV | 0.045 |
| 4 | DIFPQDVPA | 0.045 |
| 77 | LTGEGNFNW | 0.045 |
| 313 | TIPGQISQV | 0.045 |
| 93 | YLPTEREVS | 0.040 |
| 230 | YILTGKVEA | 0.030 |
| 76 | SLTGEGNFN | 0.030 |
| 228 | NVYILTGKV | 0.030 |
| 57 | KSWVKGLEH | 0.030 |
| 276 | FVNPLKTFV | 0.030 |
| 30 | VVIWNTEDV | 0.030 |
| 199 | QEAQAGKKK | 0.030 |

TABLE XII-continued

158P3D2v.1-A3-9-mers
Each peptide is a portion of SEQ ID NO: 3; each start position is Specified, the length of the peptide is 9 amino acids and the end position for each peptide is the start position plus eight.

| Pos | Subsequence | Score |
|---|---|---|
| 69 | ETDVHFNSL | 0.027 |
| 319 | SQVIFRPLH | 0.027 |
| 168 | GPRCNLFRC | 0.027 |
| 124 | LQVWDYDRI | 0.027 |
| 96 | TEREVSVWR | 0.027 |
| 24 | ISYELRVVI | 0.022 |
| 159 | SVQLARNGA | 0.020 |
| 161 | QLARNGAGP | 0.020 |
| 285 | FFIWRRYWR | 0.018 |
| 250 | KRPVGKGRK | 0.018 |
| 214 | KGRPEDLEF | 0.018 |
| 78 | TGEGNFNWR | 0.018 |
| 154 | GPELCSVQL | 0.018 |
| 22 | QPISYELRV | 0.018 |

TABLE XIII

158P3D2v.1-A3-10-mers
Each peptide is a portion of SEQ ID NO: 3; each start position is Specified, the length of the peptide is 10 amino acids and the end position for each peptide is the start position plus nine.

| Pos | Subsequence | Score |
|---|---|---|
| 178 | RLRGwWPVVK | 90.000 |
| 281 | KTFVfFIWRR | 40.500 |
| 187 | KLKEaEDVER | 18.000 |
| 241 | ELLTvEEAEK | 9.000 |
| 299 | LLVLlTVFLL | 8.100 |
| 302 | LLTVfLLLVF | 6.000 |
| 122 | LVLQvWDYDR | 5.400 |
| 120 | AVLVlQVWDY | 5.400 |
| 297 | LLLLvLLTVF | 4.500 |
| 231 | ILTGkVEAEF | 4.500 |
| 242 | LLTVeEAEKR | 4.000 |
| 301 | VLLTvFLLLV | 2.700 |
| 144 | QLPDmVRGAR | 1.800 |
| 319 | SQVIfRPLHK | 1.800 |

TABLE XIII-continued

158P3D2v.1-A3-10-mers
Each peptide is a portion of SEQ ID NO: 3; each start position is Specified, the length of the peptide is 10 amino acids and the end position for each peptide is the start position plus nine.

| Pos | Subsequence | Score |
|---|---|---|
| 296 | VLLLlVLLTV | 1.350 |
| 294 | TLVLlLLVLL | 1.350 |
| 10 | VPAPpPVDIK | 1.350 |
| 48 | GEMSsDIYVK | 1.215 |
| 161 | QLARnGAGPR | 1.200 |
| 298 | LLLVlLTVFL | 0.900 |
| 77 | LTGEgNFNWR | 0.900 |
| 276 | FVNPlKTFVF | 0.900 |
| 76 | SLTGeGNFNW | 0.900 |
| 300 | LVLLtVFLLL | 0.810 |
| 123 | VLQVwDYDRI | 0.600 |
| 303 | LTVFlLLVFY | 0.450 |
| 304 | TVFLlLVFYT | 0.450 |
| 81 | GNFNwRFVFR | 0.360 |
| 17 | DIKPrQPISY | 0.360 |
| 166 | GAGPrCNLFR | 0.360 |
| 31 | VIWNtEDVVL | 0.300 |
| 107 | GPFAlEEAEF | 0.300 |
| 46 | LTGEmSSDIY | 0.300 |
| 198 | AQEAqAGKKK | 0.300 |
| 279 | PLKTfVFFIN | 0.270 |
| 278 | NPLKtFVFFI | 0.243 |
| 180 | RGWWpVVKLK | 0.225 |
| 93 | YLPTeREVSV | 0.200 |
| 140 | SLELqLPDMV | 0.200 |
| 172 | NLFRcRRLRG | 0.200 |
| 125 | QVWDyDRISA | 0.200 |
| 307 | LLLVfYTIPG | 0.180 |
| 235 | KVEAeFELLT | 0.180 |
| 96 | TEREvSVWRR | 0.162 |
| 226 | GGNVyILTGK | 0.135 |
| 293 | RTLVlLLLVL | 0.135 |
| 309 | LVFYtIPGQI | 0.135 |
| 224 | DMGGnVYILT | 0.135 |
| 271 | TSFNwFVNPL | 0.135 |
| 313 | TIPGqISQVI | 0.135 |

TABLE XIII-continued

158P3D2v.1-A3-10-mers
Each peptide is a portion of SEQ ID NO: 3; each start position is Specified, the length of the peptide is 10 amino acids and the end position for each peptide is the start position plus nine.

| Pos | Subsequence | Score |
|-----|-------------|-------|
| 256 | GRKQpEPLEK | 0.120 |
| 87 | FVFRfDYLPT | 0.100 |
| 101 | SVWRrSGPFA | 0.100 |
| 52 | SDIYvKSWVK | 0.090 |
| 295 | LVLLlLVLLT | 0.090 |
| 148 | MVRGaRGPEL | 0.090 |
| 306 | FLLLvEYTIP | 0.090 |
| 45 | PLTGeMSSDI | 0.090 |
| 286 | FIWRrYWRTL | 0.090 |
| 19 | KPRQpISYEL | 0.081 |
| 280 | LKTFvFFIWR | 0.072 |
| 62 | GLEHdKQETD | 0.060 |
| 259 | QPEPlEKPSR | 0.060 |
| 284 | VFFIwRRYWR | 0.060 |
| 196 | REAQeAQAGK | 0.060 |
| 82 | NFNWrFVRF | 0.054 |
| 141 | LELQlPDMVR | 0.054 |
| 121 | VLVLqVWDYD | 0.045 |
| 308 | LLVEyTIPGQ | 0.045 |
| 12 | APPPvDIKPR | 0.045 |
| 39 | VLDDeNPLTG | 0.040 |
| 84 | NWRFvFRFDY | 0.036 |
| 168 | GPRCnLERCR | 0.036 |
| 117 | RQPAvLVLQV | 0.036 |
| 21 | RQPIsYELRV | 0.036 |
| 312 | YTIPgQISQV | 0.034 |
| 272 | SFNWfVNPLK | 0.030 |
| 58 | SWVKgLEHDK | 0.030 |
| 200 | EAQAgKKKRK | 0.030 |
| 30 | VVIWnTEDVV | 0.030 |
| 283 | FVFFiWRRYW | 0.030 |
| 137 | FLGSlELQLP | 0.030 |
| 222 | FTDMgGNVYI | 0.030 |
| 29 | RVVIwNTEDV | 0.030 |
| 95 | PTEReVSVWR | 0.030 |

TABLE XIII-continued

158P3D2v.1-A3-10-mers
Each peptide is a portion of SEQ ID NO: 3; each start position is Specified, the length of the peptide is 10 amino acids and the end position for each peptide is the start position plus nine.

| Pos | Subsequence | Score |
|-----|-------------|-------|
| 37 | DVVLdDENPL | 0.027 |
| 78 | TGEGnFNWRF | 0.027 |
| 9 | DVPApPPVDI | 0.027 |
| 317 | QISQvIFRPL | 0.027 |
| 270 | KTSFnWFVNP | 0.027 |
| 246 | EEAEkRPVGK | 0.027 |
| 197 | EAQEaQAGKK | 0.027 |
| 131 | RISAnDFLGS | 0.024 |
| 24 | ISYElRVVIW | 0.022 |
| 261 | EPLEkPSRPK | 0.020 |
| 314 | IPGQiSQVIF | 0.020 |
| 202 | QAGKkKRKQR | 0.020 |
| 89 | FRFDyLPTER | 0.020 |
| 185 | VVKLkEAEDV | 0.020 |
| 316 | GQISqVIFRP | 0.018 |

TABLE XIV

158P3D2v.1-A1101-9-mers
Each peptide is a portion of SEQ ID NO: 3; each start position is Specified, the length of the peptide is 9 amino acids and the end position for each peptide is the start position plus eight.

| Pos | Subsequence | Score |
|-----|-------------|-------|
| 320 | QVIFRPLHK | 6.000 |
| 281 | KTFVFFIWR | 2.400 |
| 59 | WVKGLEHDK | 2.000 |
| 316 | GQISQVIFR | 1.080 |
| 198 | AQEAQAGKK | 0.600 |
| 53 | DIYVKSWVK | 0.480 |
| 242 | LLTVEEAEK | 0.400 |
| 21 | RQPISYELR | 0.360 |
| 243 | LTVEEAEKR | 0.300 |
| 201 | AQAGKKKRK | 0.300 |
| 49 | EMSSDIYVK | 0.240 |
| 227 | GNVYILTGK | 0.180 |
| 123 | VLQVWDYDR | 0.160 |
| 257 | RKQPEPLEK | 0.120 |

TABLE XIV-continued

158P3D2v.1-A1101-9-mers
Each peptide is a portion of SEQ ID NO: 3; each start position is Specified, the length of the peptide is 9 amino acids and the end position for each peptide is the start position plus eight.

| Pos | Subsequence | Score |
|---|---|---|
| 90 | RFDYLPTER | 0.120 |
| 282 | TFVFFIWRR | 0.120 |
| 170 | RCNLFRCRR | 0.120 |
| 285 | FFIWRRYWR | 0.120 |
| 293 | RTLVLLLLV | 0.090 |
| 300 | LVLLTVFLL | 0.090 |
| 273 | FNWFVNPLK | 0.080 |
| 181 | GWWPVVKLK | 0.060 |
| 250 | KRPVGKGRK | 0.060 |
| 109 | FALEEAEFR | 0.060 |
| 247 | EAEKRPVGK | 0.060 |
| 197 | EAQEAQAGK | 0.060 |
| 235 | KVEAEFELL | 0.060 |
| 142 | ELQLPDMVR | 0.048 |
| 156 | ELCSVQLAR | 0.048 |
| 145 | LPDMVRGAR | 0.040 |
| 304 | TVFLLLVFY | 0.040 |
| 82 | NFNWRFVFR | 0.040 |
| 101 | SVWRRSGPF | 0.040 |
| 228 | NVYILTGKV | 0.040 |
| 162 | LARNGAGPR | 0.040 |
| 95 | LVLLLLVLL | 0.030 |
| 77 | LTGEGNFNW | 0.030 |
| 199 | QEAQAGKKK | 0.030 |
| 303 | LTVFLLLVF | 0.030 |
| 38 | VVLDDENPL | 0.030 |
| 30 | VVIWNTEDV | 0.030 |
| 290 | RYWRTLVLL | 0.024 |
| 276 | FVNPLKTFV | 0.020 |
| 179 | LRGWWPVVK | 0.020 |
| 11 | PAPPPVDIK | 0.020 |
| 159 | SVQLARNGA | 0.020 |
| 172 | NLFRCRRLR | 0.016 |
| 204 | GKKKRKQRR | 0.012 |
| 306 | FLLLVFYTI | 0.012 |
| 301 | VLLTVFLLL | 0.012 |
| 121 | VLVLQVWDY | 0.012 |
| 96 | TEREVSVWR | 0.012 |
| 178 | RLRGWWPVV | 0.012 |
| 297 | LLLLVLLTV | 0.012 |
| 294 | TLVLLLLVL | 0.012 |
| 232 | LTGKVEAEF | 0.010 |
| 222 | FTDMGGNVY | 0.010 |
| 55 | YVKSWVKGL | 0.010 |
| 46 | LTGEMSSDI | 0.010 |
| 29 | RVVIWNTED | 0.009 |
| 124 | LQVWDYDRI | 0.009 |
| 270 | KTSFNWFVN | 0.009 |
| 86 | RFVFRFDYL | 0.009 |
| 319 | SQVIFRPLH | 0.009 |
| 302 | LLTVFLLLV | 0.008 |
| 87 | FVFRFDYLP | 0.008 |
| 137 | FLGSLELQL | 0.008 |
| 167 | AGPRCNLFR | 0.008 |
| 31 | VIWNTEDVV | 0.008 |
| 81 | GNFNWRFVF | 0.007 |
| 48 | GEMSSDIYV | 0.007 |
| 208 | RKQRRRKGR | 0.006 |
| 206 | KKRKQRRRK | 0.006 |
| 154 | GPELCSVQL | 0.006 |
| 230 | YILTGKVEA | 0.006 |
| 22 | QPISYELRV | 0.006 |
| 299 | LLVLLTVFL | 0.006 |
| 193 | DVEREAQEA | 0.006 |
| 298 | LLLVLLTVF | 0.006 |
| 265 | KPSRPKTSF | 0.006 |
| 166 | GAGPRCNLF | 0.006 |
| 200 | EAQAGKKKR | 0.006 |
| 175 | RCRRLRGWW | 0.006 |
| 268 | RPKTSENWF | 0.006 |
| 262 | PLEKPSRPK | 0.004 |

TABLE XIV-continued

158P3D2v.1-A1101-9-mers
Each peptide is a portion of SEQ ID NO: 3; each start position is Specified, the length of the peptide is 9 amino acids and the end position for each peptide is the start position plus eight.

| Pos | Subsequence | Score |
|---|---|---|
| 25 | SYELRVVIW | 0.004 |
| 2 | WIDIFPQDV | 0.004 |
| 78 | TGEGNFNWR | 0.004 |
| 188 | LKEAEDVER | 0.004 |
| 309 | LVFYTIPGQ | 0.004 |
| 118 | QPAVLVLQV | 0.004 |
| 313 | TIPGQISQV | 0.004 |
| 283 | FVFFIWRRY | 0.004 |
| 310 | VFYTIPGQI | 0.004 |
| 140 | SLELQLPDM | 0.004 |
| 131 | RISANDELG | 0.004 |
| 79 | GEGNENWRF | 0.004 |
| 312 | YTIPGQISQ | 0.003 |
| 278 | NPLKTFVFF | 0.003 |
| 120 | AVLVLQVWD | 0.003 |

TABLE XV

158P3D2v.1-A1101-10-mers
Each peptide is a portion of SEQ ID NO: 3; each start position is Specified, the length of the peptide is 10 amino acids and the end position for each peptide is the start position plus nine.

| Pos | Subsequence | Score |
|---|---|---|
| 281 | KTFVfFIWRR | 2.400 |
| 319 | SQVIfRPLHK | 1.800 |
| 122 | LVLQvWDYDR | 1.200 |
| 178 | RLRGwWPVVK | 1.200 |
| 48 | GEMSsDIYVK | 0.720 |
| 198 | AQEAqAGKKK | 0.300 |
| 166 | GAGPrCNLFR | 0.240 |
| 187 | KLKEaEDVER | 0.240 |
| 272 | SFNWfVNPLK | 0.200 |
| 10 | VPAPpPVDIK | 0.200 |
| 77 | LTGEgNFNWR | 0.200 |
| 241 | ELLTvEEAEK | 0.180 |
| 196 | REAQeAQAGK | 0.180 |

TABLE XV-continued

158P3D2v.1-A1101-10-mers
Each peptide is a portion of SEQ ID NO: 3; each start position is Specified, the length of the peptide is 10 amino acids and the end position for each peptide is the start position plus nine.

| Pos | Subsequence | Score |
|---|---|---|
| 284 | VFFIwRRYWR | 0.160 |
| 256 | GRKQpEPLEK | 0.120 |
| 29 | RVVIwNTEDV | 0.090 |
| 293 | RTLV1LLLVL | 0.090 |
| 125 | QVWDyDRISA | 0.080 |
| 144 | QLPDmVRGAR | 0.080 |
| 161 | QLARnGAGPR | 0.080 |
| 242 | LLTVeEAEKR | 0.080 |
| 226 | GGNVyILTGK | 0.060 |
| 180 | RGWWpVVKLK | 0.060 |
| 52 | SDIYvKSWVK | 0.060 |
| 120 | AVLV1QVWDY | 0.060 |
| 300 | LVLLtVFLLL | 0.060 |
| 197 | EAQEaQAGKK | 0.060 |
| 276 | FVNP1KTFVF | 0.060 |
| 81 | GNFNwRFVFR | 0.048 |
| 290 | RYWRtLVLLL | 0.048 |
| 101 | SVWRrSGPFA | 0.040 |
| 259 | QPEP1EKPSR | 0.040 |
| 309 | LVEYtIPGQI | 0.040 |
| 21 | RQPIsYELRV | 0.036 |
| 141 | LELQ1PDMVR | 0.036 |
| 117 | RQPAvLVLQV | 0.036 |
| 58 | SWVKgLEHDK | 0.030 |
| 200 | EAQAgKKKRK | 0.030 |
| 30 | VVIWnTEDVV | 0.030 |
| 96 | TEREvSVWRR | 0.024 |
| 12 | APPPvDIKPR | 0.020 |
| 148 | MVRGaRGPEL | 0.020 |
| 202 | QAGKkKRKQR | 0.020 |
| 185 | VVKLkEAEDV | 0.020 |
| 95 | PTEReVSVWR | 0.020 |
| 299 | LLVL1TVELL | 0.018 |
| 246 | EEAEkRPVGK | 0.018 |
| 303 | LTVF1LLVEY | 0.015 |
| 312 | YTIPgQISQV | 0.015 |

TABLE XV-continued

158P3D2v.1-A1101-10-mers
Each peptide is a portion of SEQ ID NO: 3; each start position is Specified, the length of the peptide is 10 amino acids and the end position for each peptide is the start position plus nine.

| Pos | Subsequence | Score |
|---|---|---|
| 168 | GPRCnLFRCR | 0.012 |
| 235 | KVEAeFELLT | 0.012 |
| 19 | KPRQpISYEL | 0.012 |
| 304 | TVFLlLVFYT | 0.012 |
| 296 | VLLLlVLLTV | 0.012 |
| 107 | GPFAlEEAEF | 0.012 |
| 76 | SLTGeGNFNW | 0.012 |
| 301 | VLLTvFLLLV | 0.012 |
| 268 | RPKTsFNWFV | 0.012 |
| 222 | FTDMgGNVYI | 0.010 |
| 46 | LTGEmSSDIY | 0.010 |
| 37 | DVVLdDENPL | 0.009 |
| 261 | EPLEkPSRPK | 0.009 |
| 278 | NPLKtFVFFI | 0.009 |
| 316 | GQISqVIFRP | 0.008 |
| 280 | LKTFvFFIWR | 0.008 |
| 87 | FVFRfDYLPT | 0.008 |
| 302 | LLTVfLLLVF | 0.008 |
| 89 | FRFDyLPTER | 0.008 |
| 31 | VINNtEDVVL | 0.008 |
| 207 | KRKQrRRKGR | 0.006 |
| 205 | KKKRkQRRRK | 0.006 |
| 216 | RPEDlEFTDM | 0.006 |
| 249 | EKRPvGKGRK | 0.006 |
| 294 | TLVLlLLVLL | 0.006 |
| 305 | VFLLlVFYTI | 0.006 |
| 82 | NFNWrFVFRF | 0.006 |
| 297 | LLLLvLLTVF | 0.006 |
| 199 | QEAQaGKKKR | 0.006 |
| 295 | LVLLlLVLLT | 0.006 |
| 154 | GPELcSVQLA | 0.006 |
| 151 | GARGpELCSV | 0.006 |
| 9 | DVPApPPVDI | 0.006 |
| 298 | LLLVlLTVFL | 0.006 |
| 248 | AEKRpVGKGR | 0.006 |

TABLE XV-continued

158P3D2v.1-A1101-10-mers
Each peptide is a portion of SEQ ID NO: 3; each start position is Specified, the length of the peptide is 10 amino acids and the end position for each peptide is the start position plus nine.

| Pos | Subsequence | Score |
|---|---|---|
| 229 | VYILtGKVEA | 0.006 |
| 67 | KQETdVHFNS | 0.005 |
| 123 | VLQVwDYDRI | 0.004 |
| 93 | YLPTeREVSV | 0.004 |
| 283 | FVFFiWRRYW | 0.004 |
| 203 | AGKKkRKQRR | 0.004 |
| 231 | ILTGkVEAEF | 0.004 |
| 108 | PFALeEAEFR | 0.004 |
| 140 | SLELqLPDMV | 0.004 |
| 313 | TIPGqISQVI | 0.004 |
| 155 | PELCsVQLAR | 0.004 |
| 38 | VVLDdENPLT | 0.003 |
| 275 | WFVNpLKTFV | 0.003 |
| 270 | KTSFnWFVNP | 0.003 |
| 54 | IYVKsWVKGL | 0.003 |
| 131 | RISAnDFLGS | 0.002 |

TABLE XVI

158P3D2v.1-A24-9-mers
Each peptide is a portion of SEQ ID NO: 3; each start position is Specified, the length of the peptide is 9 amino acids and the end position for each peptide is the start position plus eight.

| Pos | Subsequence | Score |
|---|---|---|
| 290 | RYWRTLVLL | 400.000 |
| 86 | RFVFRFDYL | 72.000 |
| 272 | SFNWFVNPL | 36.000 |
| 275 | WFVNPLKTF | 15.000 |
| 235 | KVEAEFELL | 14.400 |
| 318 | ISQVIFRPL | 10.080 |
| 301 | VLLTVFLLL | 10.080 |
| 92 | DYLPTEREV | 9.900 |
| 180 | RGWWPVVKL | 8.800 |
| 38 | VVLDDENPL | 8.640 |
| 255 | KGRKQPEPL | 8.000 |
| 25 | SYELRVVIW | 7.500 |
| 299 | LLVLLTVFL | 7.200 |

TABLE XVI-continued

158P3D2v.1-A24-9-mers
Each peptide is a portion of SEQ ID NO: 3;
each start position is Specified, the length
of the peptide is 9 amino acids and the end
position for each peptide is the start
position plus eight.

| Pos | Subsequence | Score |
| --- | --- | --- |
| 294 | TLVLLLLVL | 7.200 |
| 295 | LVLLLLVLL | 7.200 |
| 133 | SANDFLGSL | 7.200 |
| 310 | VFYTIPGQI | 7.000 |
| 171 | CNLFRCRRL | 6.000 |
| 32 | IWNTEDVVL | 6.000 |
| 154 | GPELCSVQL | 6.000 |
| 311 | FYTIPGQIS | 6.000 |
| 300 | LVLLTVFLL | 6.000 |
| 268 | RPKTSFNWF | 5.760 |
| 69 | ETDVHFNSL | 5.760 |
| 214 | KGRPEDLEF | 5.280 |
| 137 | FLGSLELQL | 4.800 |
| 291 | YWRTLVLLL | 4.800 |
| 55 | YVKSWVKGL | 4.000 |
| 224 | DMGGNVYIL | 4.000 |
| 165 | NGAGPRCNL | 4.000 |
| 287 | IWRRYWRTL | 4.000 |
| 265 | KPSRPKTSF | 4.000 |
| 303 | LTVFLLLVF | 3.600 |
| 298 | LLLVLLTVF | 3.600 |
| 278 | NPLKTFVFF | 3.600 |
| 232 | LTGKVEAEF | 3.080 |
| 277 | VNPLKTFVF | 3.000 |
| 75 | NSLTGEGNF | 3.000 |
| 166 | GAGPRCNLF | 2.880 |
| 306 | FLLLVFYTI | 2.520 |
| 83 | FNWRFVFRF | 2.000 |
| 101 | SVWRRSGPF | 2.000 |
| 81 | GNFNWRFVF | 2.000 |
| 314 | IPGQISQVI | 1.680 |
| 124 | LQVWDYDRI | 1.500 |
| 24 | ISYELRVVI | 1.440 |
| 10 | VPAPPPVDI | 1.200 |
| 46 | LTGEMSSDI | 1.200 |
| 108 | PFALEEAEF | 1.100 |
| 305 | VFLLLVFYT | 0.900 |
| 54 | IYVKSWVKG | 0.825 |
| 289 | RRYWRTLVL | 0.800 |
| 212 | RRKGRPEDL | 0.800 |
| 234 | GKVEAEFEL | 0.792 |
| 229 | VYILTGKVE | 0.750 |
| 140 | SLELCLPDM | 0.750 |
| 116 | FRQPAVLVL | 0.720 |
| 128 | DYDRISAND | 0.700 |
| 221 | EFTDMGGNV | 0.600 |
| 130 | DRISANDFL | 0.600 |
| 292 | WRTLVLLLL | 0.560 |
| 115 | EFRQPAVLV | 0.500 |
| 88 | VFRFDYLPT | 0.500 |
| 284 | VFFIWRRYW | 0.500 |
| 149 | VRGARGPEL | 0.440 |
| 135 | NDFLGSLEL | 0.440 |
| 114 | AEFRCPAVL | 0.400 |
| 103 | WRRSGPFAL | 0.400 |
| 66 | DKQEIDVHF | 0.360 |
| 293 | RTLVLLLLV | 0.360 |
| 315 | PGQISQVIF | 0.300 |
| 67 | KQETDVHFN | 0.300 |
| 190 | EAEDVEREA | 0.277 |
| 129 | YDRISANDF | 0.240 |
| 175 | RCRRLRGWW | 0.240 |
| 259 | QPEPLEKPS | 0.216 |
| 276 | FVNPLKTFV | 0.216 |
| 297 | LLLLVLLTV | 0.210 |
| 150 | RGARGPELC | 0.200 |
| 270 | KTSFNWFVN | 0.200 |
| 164 | RNGAGPRCN | 0.200 |
| 79 | GEGNFNWRF | 0.200 |
| 178 | RLRGWWPVV | 0.200 |
| 193 | DVEREAQEA | 0.198 |

TABLE XVI-continued

158P3D2v.1-A24-9-mers
Each peptide is a portion of SEQ ID NO: 3;
each start position is Specified, the length
of the peptide is 9 amino acids and the end
position for each peptide is the start
position plus eight.

| Pos | Subsequence | Score |
|-----|-------------|-------|
| 62  | GLEHDKQET   | 0.198 |
| 50  | MSSDIYVKS   | 0.185 |
| 16  | VDIKPRQPI   | 0.180 |
| 296 | VLLLLVLLT   | 0.180 |
| 159 | SVQLARNGA   | 0.180 |
| 144 | QLPDMVRGA   | 0.180 |
| 106 | SGPFALEEA   | 0.165 |
| 183 | WPVVKLKEA   | 0.165 |
| 230 | YILTGKVEA   | 0.165 |
| 80  | EGNFNWRFV   | 0.150 |
| 237 | EAEFELLTV   | 0.150 |
| 43  | ENPLTGEMS   | 0.150 |
| 44  | NPLTGEMSS   | 0.150 |
| 30  | VVIWNTEDV   | 0.150 |
| 223 | TDMGGNVYI   | 0.150 |
| 22  | QPISYELRV   | 0.150 |

TABLE XVII

158P3D2v.1-A24-10-mers
Each peptide is a portion of SEQ ID NO: 3;
each start position is Specified, the length
of the peptide is 10 amino acids and the end
position for each peptide is the start
position plus nine.

| Pos | Subsequence | Score    |
|-----|-------------|----------|
| 290 | RYWRtLVLLL  | 480.000  |
| 54  | IYVKsWVKGL  | 300.000  |
| 128 | DYDRiSANDF  | 120.000  |
| 136 | DFLGsLELQL  | 36.000   |
| 115 | EFRQpAVLVL  | 20.000   |
| 82  | NFNWrFVRF   | 15.000   |
| 153 | RGPElCSVQL  | 14.400   |
| 293 | RTLVlLLLVL  | 14.400   |
| 305 | VFLLlVFYTI  | 12.600   |
| 19  | KPRQpISYEL  | 12.320   |
| 170 | RCNLfRCRRL  | 12.000   |
| 25  | SYELrVVIWN  | 10.500   |

TABLE XVII-continued

158P3D2v.1-A24-10-mers
Each peptide is a portion of SEQ ID NO: 3;
each start position is Specified, the length
of the peptide is 10 amino acids and the end
position for each peptide is the start
position plus nine.

| Pos | Subsequence | Score  |
|-----|-------------|--------|
| 300 | LVLLtVFLLL  | 10.080 |
| 92  | DYLPtEREVS  | 9.000  |
| 229 | VYILtGKVEA  | 8.250  |
| 164 | RNGAgPRCNL  | 8.000  |
| 37  | DVVLdDENPL  | 7.200  |
| 294 | TLVLlLLVLL  | 7.200  |
| 298 | LLLVlLTVFL  | 7.200  |
| 317 | QISQvIFRPL  | 6.720  |
| 299 | LLVLlTVFLL  | 6.000  |
| 113 | EAEFrQPAVL  | 6.000  |
| 291 | YWRTlVLLLL  | 5.600  |
| 271 | TSFNwFVNPL  | 4.800  |
| 134 | ANDFlGSLEL  | 4.400  |
| 233 | TGKVeAEFEL  | 4.400  |
| 148 | MVRGaRGPEL  | 4.400  |
| 31  | VIWNtEDVVL  | 4.000  |
| 286 | FIWRrYWRTL  | 4.000  |
| 132 | ISANdFLGSL  | 4.000  |
| 102 | VWRRsGPFAL  | 4.000  |
| 277 | VNPLkTFVFF  | 3.600  |
| 276 | FVNPlKTFVF  | 3.600  |
| 297 | LLLLvLLTVF  | 3.600  |
| 231 | ILTGkVEAEF  | 3.080  |
| 80  | EGNFnWRFVF  | 3.000  |
| 78  | TGEGnFNWRF  | 3.000  |
| 100 | VSVWrRSGPF  | 3.000  |
| 313 | TIPGqISQVI  | 2.520  |
| 302 | LLTVfLLLVF  | 2.400  |
| 165 | NGAGpRCNLF  | 2.400  |
| 107 | GPFAlEEAEF  | 2.200  |
| 216 | RPEDlEFTDM  | 2.160  |
| 314 | IPGQiSQVIF  | 2.000  |
| 74  | FNSLtGEGNF  | 2.000  |
| 274 | NWFVnPLKTF  | 2.000  |
| 9   | DVPApPPVDI  | 1.500  |
| 278 | NPLKtFVFFI  | 1.500  |

TABLE XVII-continued

158P3D2v.1-A24-10-mers
Each peptide is a portion of SEQ ID NO: 3; each start position is Specified, the length of the peptide is 10 amino acids and the end position for each peptide is the start position plus nine.

| Pos | Subsequence | Score |
|---|---|---|
| 123 | VLQVwDYDRI | 1.500 |
| 309 | LVFYtIPGQI | 1.400 |
| 282 | TFVFfIWRRY | 1.050 |
| 222 | FTDMgGNVYI | 1.000 |
| 275 | WFVNpLKTFV | 0.900 |
| 139 | GSLElQLPDM | 0.900 |
| 234 | GKVEaEFELL | 0.864 |
| 239 | EFELlTVEEA | 0.825 |
| 211 | RRRKgRPEDL | 0.800 |
| 289 | RRYWrTLVLL | 0.800 |
| 285 | FFIWrRYWRT | 0.750 |
| 73 | HFNSlTGEGN | 0.750 |
| 221 | EFTDmGGNVY | 0.720 |
| 68 | QETDvHFNSL | 0.691 |
| 223 | TDMGgNVYIL | 0.600 |
| 310 | VFYTiPGQIS | 0.600 |
| 311 | FYTIpGQISQ | 0.500 |
| 173 | LFRCrRLRGW | 0.500 |
| 85 | WRFVfRFDYL | 0.480 |
| 61 | KGLEhDKQET | 0.475 |
| 213 | RKGRpEDLEF | 0.440 |
| 179 | LRGWwPVVKL | 0.440 |
| 267 | SRPKtSFNWF | 0.432 |
| 258 | KQPEpLEKPS | 0.432 |
| 67 | KQETdVHFNS | 0.420 |
| 129 | YDRIsANDFL | 0.400 |
| 254 | GKGRkQPEPL | 0.400 |
| 288 | WRRYwRTLVL | 0.400 |
| 117 | RQPAvLVLQV | 0.360 |
| 29 | RVVIwNTEDV | 0.300 |
| 235 | KVEAeFELLT | 0.300 |
| 264 | EKPSrPKTSF | 0.300 |
| 21 | RQPIsYELRV | 0.300 |
| 105 | RSGPfALEEA | 0.264 |
| 214 | KGRPeDLEFT | 0.240 |

TABLE XVII-continued

158P3D2v.1-A24-10-mers
Each peptide is a portion of SEQ ID NO: 3; each start position is Specified, the length of the peptide is 10 amino acids and the end position for each peptide is the start position plus nine.

| Pos | Subsequence | Score |
|---|---|---|
| 131 | RISAnDFLGS | 0.240 |
| 1 | MWIDiFPQDV | 0.216 |
| 296 | VLLLlVLLTV | 0.210 |
| 268 | RPKTsFNWFV | 0.200 |
| 265 | KPSRpKTSFN | 0.200 |
| 65 | HDKQeTDVHF | 0.200 |
| 150 | RGARgPELCS | 0.200 |
| 227 | GNVYiLTGKV | 0.198 |
| 154 | GPELcSVQLA | 0.180 |
| 303 | LTVFlLLVFY | 0.180 |
| 38 | VVLDdENPLT | 0.180 |
| 312 | YTIPgQISQV | 0.180 |
| 158 | CSVQlARNGA | 0.180 |
| 143 | LQLPdMVRGA | 0.180 |
| 295 | LVLLlLVLLT | 0.180 |
| 244 | TVEEaEKRPV | 0.180 |
| 75 | NSLTgEGNFN | 0.180 |

TABLE XVIII

158P3D2v.1-B7-9-mers
Each peptide is a portion of SEQ ID NO: 3; each start position is Specified, the length of the peptide is 9 amino acids and the end position for each peptide is the start position plus eight.

| Pos | Subsequence | Score |
|---|---|---|
| 255 | KGRKQPEPL | 40.000 |
| 154 | GPELCSVQL | 24.000 |
| 300 | LVLLTVFLL | 20.000 |
| 55 | YVKSWVKGL | 20.000 |
| 168 | GPRCNLFRC | 20.000 |
| 295 | LVLLLLVLL | 20.000 |
| 38 | VVLDDENPL | 20.000 |
| 133 | SANDFLGSL | 12.000 |
| 10 | VPAPPPVDI | 12.000 |
| 165 | NGAGPRCNL | 9.000 |
| 314 | IPGQISQVI | 8.000 |
| 180 | RGWWPVVKL | 6.000 |

TABLE XVIII-continued

158P3D2v.1-B7-9-mers
Each peptide is a portion of SEQ ID NO: 3;
each start position is Specified, the length
of the peptide is 9 amino acids and the end
position for each peptide is the start
position plus eight.

| Pos | Subsequence | Score |
|---|---|---|
| 235 | KVEAEFELL | 6.000 |
| 294 | TLVLLLLVL | 4.000 |
| 94 | LPTEREVSV | 4.000 |
| 22 | QPISYELRV | 4.000 |
| 301 | VLLTVFLLL | 4.000 |
| 291 | YWRTLVLLL | 4.000 |
| 318 | ISQVIFRPL | 4.000 |
| 103 | WRRSGPFAL | 4.000 |
| 299 | LLVLLTVFL | 4.000 |
| 118 | QPAVLVLQV | 4.000 |
| 137 | FLGSLELQL | 4.000 |
| 287 | IWRRYWRTL | 4.000 |
| 171 | CNLFRCRRL | 4.000 |
| 224 | DMGGNVYIL | 4.000 |
| 19 | KPRQPISYE | 3.000 |
| 178 | RLRGWWPVV | 2.000 |
| 183 | WPVVKLKEA | 2.000 |
| 114 | AEFRQPAVL | 1.200 |
| 69 | ETDVHFNSL | 1.200 |
| 276 | FVNPLKTFV | 1.000 |
| 27 | ELRVVIWNT | 1.000 |
| 30 | VVIWNTEDV | 1.000 |
| 228 | NVYILTGKV | 1.000 |
| 151 | GARGPELCS | 0.900 |
| 159 | SVQLARNGA | 0.750 |
| 148 | MVRGARGPE | 0.750 |
| 24 | ISYELRVVI | 0.600 |
| 265 | KPSRPKTSF | 0.600 |
| 12 | APPPVDIKP | 0.600 |
| 292 | WRTLVLLLL | 0.400 |
| 32 | IWNTEDVVL | 0.400 |
| 289 | RRYWRTLVL | 0.400 |
| 149 | VRGARGPEL | 0.400 |
| 46 | LTGEMSSDI | 0.400 |
| 306 | FLLLVFYTI | 0.400 |

TABLE XVIII-continued

158P3D2v.1-B7-9-mers
Each peptide is a portion of SEQ ID NO: 3;
each start position is Specified, the length
of the peptide is 9 amino acids and the end
position for each peptide is the start
position plus eight.

| Pos | Subsequence | Score |
|---|---|---|
| 272 | SFNWFVNPL | 0.400 |
| 234 | GKVEAEFEL | 0.400 |
| 278 | NPLKTFVFF | 0.400 |
| 130 | DRISANDFL | 0.400 |
| 86 | RFVFRFDYL | 0.400 |
| 135 | NDFLGSLEL | 0.400 |
| 44 | NPLTGEMSS | 0.400 |
| 212 | RRKGRPEDL | 0.400 |
| 268 | RPKTSFNWF | 0.400 |
| 290 | RYWRTLVLL | 0.400 |
| 116 | FRQPAVLVL | 0.400 |
| 124 | LQVWDYDRI | 0.400 |
| 140 | SLELQLPDM | 0.300 |
| 288 | WRRYWRTLV | 0.300 |
| 162 | LARNGAGPR | 0.300 |
| 115 | EFRQPAVLV | 0.300 |
| 175 | RCRRLRGWW | 0.300 |
| 214 | KGRPEDLEF | 0.200 |
| 80 | EGNFNWRFV | 0.200 |
| 302 | LLTVFLLLV | 0.200 |
| 297 | LLLLVLLTV | 0.200 |
| 261 | EPLEKPSRP | 0.200 |
| 107 | GPFALEEAE | 0.200 |
| 31 | VIWNTEDVV | 0.200 |
| 313 | TIPGQISQV | 0.200 |
| 251 | RPVGKGRKQ | 0.200 |
| 293 | RTLVLLLLV | 0.200 |
| 6 | FPQDVPAPP | 0.200 |
| 237 | EAEFELLTV | 0.180 |
| 113 | EAEFRQPAV | 0.180 |
| 193 | DVEREAQEA | 0.150 |
| 120 | AVLVLQVWD | 0.150 |
| 259 | QPEPLEKPS | 0.120 |
| 223 | TDMGGNVYI | 0.120 |
| 283 | FVFFIWRRY | 0.100 |
| 106 | SGPFALEEA | 0.100 |

TABLE XVIII-continued

158P3D2v.1-B7-9-mers
Each peptide is a portion of SEQ ID NO: 3;
each start position is Specified, the length
of the peptide is 9 amino acids and the end
position for each peptide is the start
position plus eight.

| Pos | Subsequence | Score |
|---|---|---|
| 101 | SVWRRSGPF | 0.100 |
| 150 | RGARGPELC | 0.100 |
| 304 | TVFLLLVFY | 0.100 |
| 42 | DENPLTGEM | 0.100 |
| 296 | VLLLLVLLT | 0.100 |
| 125 | QVWDYDRIS | 0.100 |
| 225 | MGGNVYILT | 0.100 |
| 144 | QLPDMVRGA | 0.100 |
| 102 | VWRRSGPFA | 0.100 |
| 4 | DIFPQDVPA | 0.100 |
| 88 | VERFDYLPT | 0.100 |
| 209 | KQRRRKGRP | 0.100 |
| 286 | FIWRRYWRT | 0.100 |
| 230 | YILTGKVEA | 0.100 |
| 16 | VDIKPRQPI | 0.090 |
| 145 | LPDMVRGAR | 0.090 |
| 190 | EAEDVEREA | 0.090 |

TABLE XIX

158P3D2v.1-B7-10-mers
Each peptide is a portion of SEQ ID NO: 3;
each start position is Specified, the length
of the peptide is 10 amino acids and the end
position for each peptide is the start
position plus nine.

| Pos | Subsequence | Score |
|---|---|---|
| 19 | KPRQpISYEL | 800.000 |
| 148 | MVRGaRGPEL | 200.000 |
| 37 | DVVLdDENPL | 20.000 |
| 300 | LVLLtVFLLL | 20.000 |
| 164 | RNGAgPRCNL | 9.000 |
| 278 | NPLKtFVFFI | 8.000 |
| 151 | GARGpELCSV | 6.000 |
| 216 | RPEDlEFTDM | 6.000 |
| 31 | VIWNtEDVVL | 4.000 |
| 298 | LLLVlLTVFL | 4.000 |
| 294 | TLVLlLLVLL | 4.000 |

TABLE XIX-continued

158P3D2v.1-B7-10-mers
Each peptide is a portion of SEQ ID NO: 3;
each start position is Specified, the length
of the peptide is 10 amino acids and the end
position for each peptide is the start
position plus nine.

| Pos | Subsequence | Score |
|---|---|---|
| 129 | YDRIsANDFL | 4.000 |
| 132 | ISANdFLGSL | 4.000 |
| 288 | WRRYwRTLVL | 4.000 |
| 170 | RCNLfRCRRL | 4.000 |
| 22 | QPISyELRVV | 4.000 |
| 115 | EFRQpAVLVL | 4.000 |
| 153 | RGPElCSVQL | 4.000 |
| 293 | RTLVlLLLVL | 4.000 |
| 291 | YWRTlVLLLL | 4.000 |
| 286 | FIWRrYWRTL | 4.000 |
| 271 | TSFNwFVNPL | 4.000 |
| 233 | TGKVeAEFEL | 4.000 |
| 268 | RPKTsFNWFV | 4.000 |
| 299 | LLVLlTVELL | 4.000 |
| 211 | RRRKgRPEDL | 4.000 |
| 102 | VWRRsGPFAL | 4.000 |
| 317 | QISQvIFRPL | 4.000 |
| 134 | ANDFlGSLEL | 3.600 |
| 113 | EAEFrQPAVL | 3.600 |
| 9 | DVPApPPVDI | 3.000 |
| 162 | LARNgAGPRC | 3.000 |
| 309 | LVFYtIPGQI | 2.000 |
| 168 | GPRCnLFRCR | 2.000 |
| 223 | TDMGgNVYIL | 1.200 |
| 30 | VVIWnTEDVV | 1.000 |
| 29 | RVVIwNTEDV | 1.000 |
| 214 | KGRPeDLEFT | 1.000 |
| 185 | VVKLkEAEDV | 1.000 |
| 139 | GSLElQLPDM | 1.000 |
| 125 | QVWDyDRISA | 0.750 |
| 12 | APPPvDIKPR | 0.600 |
| 154 | GPELcSVQLA | 0.600 |
| 179 | LRGWwPVVKL | 0.600 |
| 295 | LVLLlLVLLT | 0.500 |
| 38 | VVLDdENPLT | 0.500 |
| 87 | FVFRrFDYLPT | 0.500 |

TABLE XIX-continued

158P3D2v.1-B7-10-mers
Each peptide is a portion of SEQ ID NO: 3; each start position is Specified, the length of the peptide is 10 amino acids and the end position for each peptide is the start position plus nine.

| Pos | Subsequence | Score |
|---|---|---|
| 101 | SVWRrSGPFA | 0.500 |
| 304 | TVFLlLVFYT | 0.500 |
| 54 | IYVKsWVKGL | 0.400 |
| 313 | TIPGqISQVI | 0.400 |
| 289 | RRYWrTLVLL | 0.400 |
| 136 | DFLGsLELQL | 0.400 |
| 234 | GKVEaEFELL | 0.400 |
| 254 | GKGRkQPEPL | 0.400 |
| 118 | QPAVlVLQVW | 0.400 |
| 314 | IPGQiSQVIF | 0.400 |
| 68 | QETDvHFNSL | 0.400 |
| 107 | GPFAlEEAEF | 0.400 |
| 123 | VLQVwDYDRI | 0.400 |
| 290 | RYWRtLVLLL | 0.400 |
| 94 | LPTErEVSVW | 0.400 |
| 265 | KPSRpKTSFN | 0.400 |
| 85 | WRFVfRFDYL | 0.400 |
| 261 | EPLEkPSRPK | 0.300 |
| 10 | VPAPpPVDIK | 0.300 |
| 120 | AVLVlQVWDY | 0.300 |
| 167 | AGPRcNLFRC | 0.300 |
| 287 | IWRRyWRTLV | 0.300 |
| 244 | TVEEaEKRPV | 0.300 |
| 251 | RPVGkGRKQP | 0.300 |
| 6 | FPQDvPAPPP | 0.300 |
| 296 | VLLLlVLLTV | 0.200 |
| 117 | RQPAvLVLQV | 0.200 |
| 44 | NPLTgEMSSD | 0.200 |
| 176 | CRRLrGWWPV | 0.200 |
| 183 | WPVVkLKEAE | 0.200 |
| 301 | VLLTvFLLLV | 0.200 |
| 227 | GNVYiLTGKV | 0.200 |
| 21 | RQPIsYELRV | 0.200 |
| 312 | YTIPgQISQV | 0.200 |
| 93 | YLPTeREVSV | 0.200 |

TABLE XIX-continued

158P3D2v.1-B7-10-mers
Each peptide is a portion of SEQ ID NO: 3; each start position is Specified, the length of the peptide is 10 amino acids and the end position for each peptide is the start position plus nine.

| Pos | Subsequence | Score |
|---|---|---|
| 235 | KVEAeFELLT | 0.150 |
| 158 | CSVQlARNGA | 0.150 |
| 283 | FVFFIWRRYW | 0.150 |
| 255 | KGRKqPEPLE | 0.150 |
| 15 | PVDIkPRQPI | 0.135 |
| 222 | FTDMgGNVYI | 0.120 |
| 209 | KQRRrKGRPE | 0.100 |
| 105 | RSGPfALEEA | 0.100 |
| 27 | ELRVvIWNTE | 0.100 |
| 273 | FNWFvNPLKT | 0.100 |
| 143 | LQLPdMVRGA | 0.100 |
| 175 | RCRRlRGWWP | 0.100 |
| 276 | FVNPlKTFVF | 0.100 |
| 61 | KGLEhDKQET | 0.100 |
| 224 | DMGGnVYILT | 0.100 |
| 178 | RLRGwWPVVK | 0.100 |
| 194 | VEREaQEAQA | 0.100 |
| 114 | AEFRqPAVLV | 0.090 |

TABLE XX

158P3D2v.1-B3501-9-mers
Each peptide is a portion of SEQ ID NO: 3; each start position is Specified, the length of the peptide is 9 amino acids and the end position for each peptide is the start position plus eight.

| Pos | Subsequence | Score |
|---|---|---|
| 268 | RPKTSENWF | 120.000 |
| 265 | KPSRPKTSF | 40.000 |
| 278 | NPLKTFVFF | 20.000 |
| 214 | KGRPEDLEF | 9.000 |
| 314 | IPGQISQVI | 8.000 |
| 94 | LPTEREVSV | 8.000 |
| 10 | VPAPPPVDI | 8.000 |
| 154 | GPELCSVQL | 6.000 |
| 168 | GPRCNLFRC | 6.000 |
| 255 | KGRKQPEPL | 6.000 |
| 133 | SANDFLGSL | 6.000 |

TABLE XX-continued

158P3D2v.1-B3501-9-mers
Each peptide is a portion of SEQ ID NO: 3;
each start position is Specified, the length
of the peptide is 9 amino acids and the end
position for each peptide is the start
position plus eight.

| Pos | Subsequence | Score |
|---|---|---|
| 318 | ISQVIFRPL | 5.000 |
| 75 | NSLTGEGNF | 5.000 |
| 118 | QPAVLVLQV | 4.000 |
| 24 | ISYELRVVI | 4.000 |
| 22 | QPISYELRV | 4.000 |
| 38 | VVLDDENPL | 3.000 |
| 55 | YVKSWVKGL | 3.000 |
| 175 | RCRRLRGWW | 3.000 |
| 166 | GAGPRCNLF | 3.000 |
| 180 | RGWWPVVKL | 2.000 |
| 183 | WPVVKLKEA | 2.000 |
| 283 | FVFFIWRRY | 2.000 |
| 304 | TVFLLLVFY | 2.000 |
| 121 | VLVLQVWDY | 2.000 |
| 44 | NPLTGEMSS | 2.000 |
| 19 | KPRQPISYE | 1.200 |
| 178 | RLRGWWPVV | 1.200 |
| 299 | LLVLLTVFL | 1.000 |
| 165 | NGAGPRCNL | 1.000 |
| 224 | DMGGNVYIL | 1.000 |
| 277 | VNPLKTFVF | 1.000 |
| 298 | LLLVLLTVF | 1.000 |
| 294 | TLVLLLLVL | 1.000 |
| 137 | FLGSLELQL | 1.000 |
| 171 | CNLFRCRRL | 1.000 |
| 101 | SVWRRSGPF | 1.000 |
| 81 | GNFNWRFVF | 1.000 |
| 300 | LVLLTVFLL | 1.000 |
| 50 | MSSDIYVKS | 1.000 |
| 83 | FNWRFVFRF | 1.000 |
| 232 | LTGKVEAEF | 1.000 |
| 303 | LTVFLLLVF | 1.000 |
| 301 | VLLTVFLLL | 1.000 |
| 295 | LVLLLLVLL | 1.000 |
| 77 | LTGEGNFNW | 1.000 |

TABLE XX-continued

158P3D2v.1-B3501-9-mers
Each peptide is a portion of SEQ ID NO: 3;
each start position is Specified, the length
of the peptide is 9 amino acids and the end
position for each peptide is the start
position plus eight.

| Pos | Subsequence | Score |
|---|---|---|
| 235 | KVEAEFELL | 0.900 |
| 151 | GARGPELCS | 0.900 |
| 46 | LTGEMSSDI | 0.800 |
| 51 | SSDIYVKSW | 0.750 |
| 132 | ISANDFLGS | 0.750 |
| 222 | FTDMGGNVY | 0.600 |
| 47 | TGEMSSDIY | 0.600 |
| 259 | QPEPLEKPS | 0.600 |
| 140 | SLELQLPDM | 0.600 |
| 212 | RRKGRPEDL | 0.600 |
| 124 | LQVWDYDRI | 0.600 |
| 293 | RTLVLLLLV | 0.400 |
| 306 | FLLLVFYTI | 0.400 |
| 251 | RPVGKGRKQ | 0.400 |
| 6 | FPQDVPAPP | 0.400 |
| 261 | EPLEKPSRP | 0.400 |
| 129 | YDRISANDF | 0.300 |
| 291 | YWRTLVLLL | 0.300 |
| 17 | DIKPRQPIS | 0.300 |
| 27 | ELRVVIWNT | 0.300 |
| 287 | IWRRYWRTL | 0.300 |
| 69 | ETDVHFNSL | 0.300 |
| 103 | WRRSGPFAL | 0.300 |
| 237 | EAEFELLTV | 0.270 |
| 216 | RPEDLEFTD | 0.240 |
| 164 | RNGAGPRCN | 0.200 |
| 234 | GKVEAEFEL | 0.200 |
| 30 | VVIWNTEDV | 0.200 |
| 313 | TIPGQISQV | 0.200 |
| 18 | IKPRQPISY | 0.200 |
| 150 | RGARGPELC | 0.200 |
| 297 | LLLLVLLTV | 0.200 |
| 42 | DENPLTGEM | 0.200 |
| 107 | GPFALEEAE | 0.200 |
| 290 | RYWRTLVLL | 0.200 |
| 302 | LLTVFLLLV | 0.200 |

TABLE XX-continued

158P3D2v.1-B3501-9-mers
Each peptide is a portion of SEQ ID NO: 3; each start position is Specified, the length of the peptide is 9 amino acids and the end position for each peptide is the start position plus eight.

| Pos | Subsequence | Score |
|---|---|---|
| 12 | APPPVDIKP | 0.200 |
| 31 | VIWNTEDVV | 0.200 |
| 276 | FVNPLKTFV | 0.200 |
| 228 | NVYILTGKV | 0.200 |
| 125 | QVWDYDRIS | 0.200 |
| 86 | RFVFRFDYL | 0.200 |
| 144 | QLPDMVRGA | 0.200 |
| 66 | DKQETDVHF | 0.200 |
| 80 | EGNFNWRFV | 0.200 |
| 85 | WRFVFRFDY | 0.200 |
| 289 | RRYWRTLVL | 0.200 |
| 270 | KTSFNWFVN | 0.200 |
| 113 | EAEFRQPAV | 0.180 |
| 190 | EAEDVEREA | 0.180 |
| 76 | SLTGEGNFN | 0.150 |
| 266 | PSRPKTSFN | 0.150 |
| 32 | IWNTEDVVL | 0.150 |
| 119 | PAVLVLQVW | 0.150 |

TABLE XXI

158P3D2v.1-B3501-10-mers
Each peptide is a portion of SEQ ID NO: 3; each start position is Specified, the length of the peptide is 10 amino acids and the end position for each peptide is the start position plus nine.

| Pos | Subsequence | Score |
|---|---|---|
| 19 | KPRQpISYEL | 120.000 |
| 216 | RPEDlEFTDM | 72.000 |
| 94 | LPTErEVSVW | 30.000 |
| 107 | GPFAlEEAEF | 30.000 |
| 268 | RPKTsFNWFV | 24.000 |
| 139 | GSLElQLPDM | 20.000 |
| 314 | IPGQiSQVIF | 20.000 |
| 118 | QPAVlVLQVW | 10.000 |
| 278 | NPLKtFVFFI | 8.000 |
| 17 | DIKPrQPISY | 6.000 |

TABLE XXI-continued

158P3D2v.1-B3501-10-mers
Each peptide is a portion of SEQ ID NO: 3; each start position is Specified, the length of the peptide is 10 amino acids and the end position for each peptide is the start position plus nine.

| Pos | Subsequence | Score |
|---|---|---|
| 22 | QPISyELRVV | 6.000 |
| 271 | TSFNwFVNPL | 5.000 |
| 24 | ISYElRVVIW | 5.000 |
| 50 | MSSDiYVKSW | 5.000 |
| 132 | ISANdFLGSL | 5.000 |
| 100 | VSVWrRSGPF | 5.000 |
| 46 | LTGEmSSDIY | 4.000 |
| 153 | RGPElCSVQL | 4.000 |
| 265 | KPSRpKTSFN | 4.000 |
| 148 | MVRGaRGPEL | 3.000 |
| 233 | TGKVeAEFEL | 3.000 |
| 151 | GARGpELCSV | 2.700 |
| 164 | RNGAgPRCNL | 2.000 |
| 120 | AVLVlQVWDY | 2.000 |
| 293 | RTLVlLLLVL | 2.000 |
| 303 | LTVFlLLVFY | 2.000 |
| 170 | RCNLfRCRRL | 2.000 |
| 37 | DVVLdDENPL | 1.500 |
| 31 | VIWNtEDVVL | 1.500 |
| 298 | LLLVlLTVFL | 1.000 |
| 317 | QISQvIFRPL | 1.000 |
| 294 | TLVLlLLVLL | 1.000 |
| 286 | FIWRrYWRTL | 1.000 |
| 299 | LLVLlTVFLL | 1.000 |
| 300 | LVLLtVFLLL | 1.000 |
| 277 | VNPLkTFVFF | 1.000 |
| 105 | RSGPfALEEA | 1.000 |
| 302 | LLTVfLLLVF | 1.000 |
| 74 | FNSLtGEGNF | 1.000 |
| 231 | ILTGkVEAEF | 1.000 |
| 80 | EGNFnWRFVF | 1.000 |
| 297 | LLLLvLLTVF | 1.000 |
| 165 | NGAGpRCNLF | 1.000 |
| 276 | FVNPlKTFVF | 1.000 |
| 113 | EAEFrQPAVL | 0.900 |
| 185 | VVKLkEAEDV | 0.900 |

TABLE XXI-continued

158P3D2v.1-B3501-10-mers
Each peptide is a portion of SEQ ID NO: 3;
each start position is Specified, the length
of the peptide is 10 amino acids and the end
position for each peptide is the start
position plus nine.

| Pos | Subsequence | Score |
| --- | --- | --- |
| 214 | KGRPeDLEFT | 0.900 |
| 162 | LARNgAGPRC | 0.900 |
| 75 | NSLTgEGNFN | 0.750 |
| 266 | PSRPkTSFNW | 0.750 |
| 123 | VLQVwDYDRI | 0.600 |
| 154 | GPELcSVQLA | 0.600 |
| 84 | NWRFvFRFDY | 0.600 |
| 211 | RRRKgRPEDL | 0.600 |
| 61 | KGLEhDKQET | 0.600 |
| 168 | GPRCnLFRCR | 0.600 |
| 158 | CSVQlARNGA | 0.500 |
| 283 | FVFFiWRRYW | 0.500 |
| 76 | SLTGeGNFNW | 0.500 |
| 9 | DVPApPPVDI | 0.400 |
| 261 | EPLEkPSRPK | 0.400 |
| 29 | RVVIwNTEDV | 0.400 |
| 21 | RQPIsYELRV | 0.400 |
| 251 | RPVGkGRKQP | 0.400 |
| 309 | LVFYtIPGQI | 0.400 |
| 6 | FPQDvPAPPP | 0.400 |
| 258 | KQPEpLEKPS | 0.400 |
| 117 | RQPAvLVLQV | 0.400 |
| 313 | TIPGqISQVI | 0.400 |
| 221 | EFTDmGGNVY | 0.400 |
| 213 | RKGRpEDLEF | 0.300 |
| 125 | QVWDyDRISA | 0.300 |
| 129 | YDRIsANDFL | 0.300 |
| 102 | VWRRsGPFAL | 0.300 |
| 115 | EFRQpAVLVL | 0.300 |
| 288 | WRRYwRTLVL | 0.300 |
| 134 | ANDFlGSLEL | 0.300 |
| 78 | TGEGnFNWRF | 0.300 |
| 38 | VVLDdENPLT | 0.300 |
| 234 | GKVEaEFELL | 0.300 |
| 65 | HDKQeTDVHF | 0.300 |

TABLE XXI-continued

158P3D2v.1-B3501-10-mers
Each peptide is a portion of SEQ ID NO: 3;
each start position is Specified, the length
of the peptide is 10 amino acids and the end
position for each peptide is the start
position plus nine.

| Pos | Subsequence | Score |
| --- | --- | --- |
| 291 | YWRTlVLLLL | 0.300 |
| 12 | APPPvDIKPR | 0.300 |
| 131 | RISAnDFLGS | 0.300 |
| 44 | NPLTgEMSSD | 0.300 |
| 51 | SSDIyVKSWV | 0.300 |
| 290 | RYWRtLVLLL | 0.200 |
| 282 | TFVFfIWRRY | 0.200 |
| 183 | WPVVkLKEAE | 0.200 |
| 10 | VPAPpPVDIK | 0.200 |
| 68 | QETDvHFNSL | 0.200 |
| 227 | GNVYiLTGKV | 0.200 |
| 93 | YLPTeREVSV | 0.200 |
| 30 | VVIWnTEDVV | 0.200 |
| 296 | VLLLlVLLTV | 0.200 |
| 150 | RGARgPELCS | 0.200 |
| 301 | VLLTvFLLLV | 0.200 |
| 289 | RRYWrTLVLL | 0.200 |
| 312 | YTIPgQISQV | 0.200 |
| 187 | KLKEaEDVER | 0.180 |

TABLE VIII

158P3D2v.17, ORF: 65-6175,
Frame +2, A1-9-mers
Each peptide is a portion of
SEQ ID NO: 29; each start position
is Specified, the length of the
peptide is 9 amino acids and the
end position for each peptide is
the start position plus eight.

| Pos | Subsequence | Score |
| --- | --- | --- |
| 1930 | FTDMGGNVY | 62.500 |
| 626 | GAEGPEIPR | 45.000 |
| 1553 | ETELTVAVF | 45.000 |
| 1576 | HIDLENRFY | 25.000 |
| 40 | EADIGELER | 25.000 |
| 217 | HGDPFQVSR | 25.000 |
| 1349 | ELDWGSKYY | 25.000 |
| 151 | ELEPGEAQL | 18.000 |
| 427 | RAEGLPALR | 18.000 |

TABLE VIII-continued

158P3D2v.17, ORF: 65-6175, Frame +2, A1-9-mers
Each peptide is a portion of SEQ ID NO: 29; each start position is Specified, the length of the peptide is 9 amino acids and the end position for each peptide is the start position plus eight.

| Pos | Subsequence | Score |
|---|---|---|
| 197 | DVELSGVMF | 18.000 |
| 583 | RAEPEPPQA | 18.000 |
| 1474 | FSEPQISRG | 13.500 |
| 1202 | ESEVLASYR | 13.500 |
| 272 | YNEYFLFEF | 11.250 |
| 1755 | TGEMSSDIY | 11.250 |
| 1306 | SLDPFLAEA | 10.000 |
| 668 | MIDPTVASQ | 10.000 |
| 1598 | EVDGYNAWR | 10.000 |
| 1511 | KADPYVVVS | 10.000 |
| 452 | LVEPYVRVS | 9.000 |
| 1146 | LVEPHSGRL | 9.000 |
| 1121 | LIELDYSGR | 9.000 |
| 267 | TSCPFYNEY | 7.500 |
| 1011 | LSDPFARVL | 7.500 |
| 786 | LQEVERLQR | 6.750 |
| 1344 | IPDPEELDW | 6.250 |
| 346 | ILDQPDGQF | 5.000 |
| 1267 | HIVPHMLRF | 5.000 |
| 327 | QTLPFMATR | 5.000 |
| 1927 | DLEFTDMGG | 4.500 |
| 703 | GTEGAAVEA | 4.500 |
| 821 | GAERRTMTR | 4.500 |
| 1466 | YPESEAVLF | 4.500 |
| 1945 | EAEFELLTV | 4.500 |
| 1200 | GVESEVLAS | 4.500 |
| 1688 | HVETRPLYH | 4.500 |
| 708 | AVEAQPLLG | 4.500 |
| 1137 | EVEPQDLAP | 4.500 |
| 585 | EPEPPQAQQ | 4.500 |
| 235 | VLEAQKLVG | 4.500 |
| 1818 | ALEEAEFRQ | 4.500 |
| 1379 | DSDGVNLIS | 3.750 |
| 1955 | EAEKRPVGK | 3.600 |
| 1906 | AQEAQAGKK | 2.700 |
| 316 | LTPPSPKAF | 2.500 |
| 1659 | SGDPEEAQA | 2.500 |
| 349 | QPDGQFYQR | 2.500 |
| 1215 | FTELVRHLT | 2.250 |
| 1967 | QPEPLEKPS | 2.250 |
| 1786 | TGEGNFNWR | 2.250 |
| 734 | RPEPMDGSG | 2.250 |
| 745 | FCLPLCHCK | 2.000 |
| 485 | FVELFPPLT | 1.800 |
| 807 | ALEVLVAGS | 1.800 |
| 1186 | EVEQPQVVL | 1.800 |
| 1578 | DLENRFYSH | 1.800 |
| 1821 | EAEFRQPAV | 1.800 |
| 471 | SAEAAAPEW | 1.800 |
| 1129 | RLEPSVPSE | 1.800 |
| 881 | LAEEPQPPL | 1.800 |
| 1184 | LLEVEQPQV | 1.800 |
| 1848 | SLELQLPDM | 1.800 |
| 543 | GSPPGAGLR | 1.500 |
| 964 | TSELPPDLL | 1.350 |
| 827 | MTRPNALDR | 1.250 |
| 1989 | KTFVFFIWR | 1.250 |
| 977 | AGLPSSLHR | 1.250 |
| 1777 | ETDVHFNSL | 1.250 |
| 1853 | LPDMVRGAR | 1.250 |
| 512 | ATHVPDLRR | 1.250 |
| 2020 | YTIPGQISQ | 1.250 |
| 1073 | FGPPVFLGR | 1.250 |
| 2011 | LTVFLLLVF | 1.250 |
| 1097 | RPELQFFPL | 1.125 |
| 1540 | FGEILELSI | 1.125 |
| 1742 | NTEDVVLDD | 1.125 |
| 1874 | GAGPRCNLF | 1.000 |
| 368 | RAGTKGFIK | 1.000 |

TABLE VIII-continued

158P3D2v.17, ORF: 65-6175,
Frame +2, A1-9-mers
Each peptide is a portion of
SEQ ID NO: 29; each start position
is Specified, the length of the
peptide is 9 amino acids and the
end position for each peptide is
the start position plus eight.

| Pos | Subsequence | Score |
|---|---|---|
| 1159 | NVCPVLREF | 1.000 |
| 2012 | TVFLLLVFY | 1.000 |
| 2028 | QVIFRPLHK | 1.000 |
| 1099 | ELQFFPLRK | 1.000 |
| 506 | LVDAALATH | 1.000 |
| 1621 | RCGLPAPEY | 1.000 |
| 710 | EAQPLLGAR | 1.000 |
| 1747 | VLDDENPLT | 1.000 |
| 1029 | VLEQTLSPL | 0.900 |
| 1057 | QEEPPLVII | 0.900 |
| 1896 | LKEAEDVER | 0.900 |
| 110 | QVELDLKYQ | 0.900 |
| 291 | LLEITVSGV | 0.900 |
| 947 | KLELFLRLG | 0.900 |
| 689 | RLEEQLGRG | 0.900 |
| 1397 | EAEVKGTVS | 0.900 |
| 1193 | VLEVAGQGV | 0.900 |
| 1943 | KVEAEFELL | 0.900 |
| 1311 | LAEAGISRQ | 0.900 |
| 1898 | EAEDVEREA | 0.900 |
| 1770 | GLEHDKQET | 0.900 |
| 1168 | RVEVLFWGL | 0.900 |

TABLE IX

158P3D2v.17, ORF: 65-6175,
Frame +2, A1-10-mers
Each peptide is a portion of
SEQ ID NO: 29; each start position
is Specified, the length of the
peptide is 10 amino acids and the
end position for each peptide is
the start position plus nine.

| Pos | Subsequence | Score |
|---|---|---|
| 452 | LVEPyVRVSF | 180.000 |
| 1200 | GVESeVLASY | 90.000 |
| 485 | FVELfPPLTR | 45.000 |
| 1967 | QPEPlEKPSR | 45.000 |

TABLE IX-continued

158P3D2v.17, ORF: 65-6175,
Frame +2, A1-10-mers
Each peptide is a portion of
SEQ ID NO: 29; each start position
is Specified, the length of the
peptide is 10 amino acids and the
end position for each peptide is
the start position plus nine.

| Pos | Subsequence | Score |
|---|---|---|
| 346 | ILDQpDGQFY | 25.000 |
| 43 | IGELfRWPHY | 22.500 |
| 1137 | EVEPqDLAPL | 18.000 |
| 1011 | LSDPfARVLI | 15.000 |
| 1474 | FSEPqISRGI | 13.500 |
| 972 | LPEPsAGLPS | 11.250 |
| 1215 | FTELvRHLTV | 11.250 |
| 476 | APEWnEQLSF | 11.250 |
| 1511 | KADPyVVVSA | 10.000 |
| 1626 | APEYrAGAVK | 9.000 |
| 807 | ALEVlVAGSR | 9.000 |
| 1168 | RVEVlFWGLR | 9.000 |
| 583 | RAEPePPQAQ | 9.000 |
| 1129 | RLEPsVPSEV | 9.000 |
| 1146 | LVEPhSGRLS | 9.000 |
| 1306 | SLDPfLAEAG | 5.000 |
| 1874 | GAGPrCNLFR | 5.000 |
| 1984 | FVNPlKTFVF | 5.000 |
| 1346 | DPEElDWGSK | 4.500 |
| 401 | DIEKnLLLPR | 4.500 |
| 708 | AVEAqPLLGA | 4.500 |
| 427 | RAEGlPALRL | 4.500 |
| 1097 | RPELqFFPLR | 4.500 |
| 1290 | MEETgDMMPK | 4.500 |
| 637 | EVEVeELLPL | 4.500 |
| 1943 | KVEAeFELLT | 4.500 |
| 1543 | ILELsISLPA | 4.500 |
| 197 | DVELsGVMFS | 4.500 |
| 947 | KLELfLRLGL | 4.500 |
| 1379 | DSDGvNLISM | 3.750 |
| 981 | SSLHrDDFSY | 3.750 |
| 399 | CSDIeKNLLL | 3.750 |
| 521 | ISHPgRAAGF | 3.000 |
| 1906 | AQEAqAGKKK | 2.700 |
| 127 | WSEEdFGAPI | 2.700 |

TABLE IX-continued

158P3D2v.17, ORF: 65-6175,
Frame +2, A1-10-mers
Each peptide is a portion of
SEQ ID NO: 29; each start position
is Specified, the length of the
peptide is 10 amino acids and the
end position for each peptide is
the start position plus nine.

| Pos | Subsequence | Score |
|---|---|---|
| 786 | LQEVeRLQRK | 2.700 |
| 1725 | DIKPrQPISY | 2.500 |
| 1576 | HIDLeNRFYS | 2.500 |
| 1747 | VLDDeNPLTG | 2.500 |
| 2011 | LTVFlLLVEY | 2.500 |
| 1117 | AAFQiIELDY | 2.500 |
| 1930 | FTDMgGNVYI | 2.500 |
| 40 | EADIgELFRW | 2.500 |
| 193 | DDEPdVELSG | 2.250 |
| 1786 | TGEGnFNWRF | 2.250 |
| 703 | GTEGaAVEAQ | 2.250 |
| 38 | GPEAdIGELF | 2.250 |
| 585 | EPEPpQAQQG | 2.250 |
| 1057 | QEEPpLVIIN | 2.250 |
| 1502 | NLAPaDPNGK | 2.000 |
| 938 | GAAPgEVCAK | 2.000 |
| 235 | VLEAqKLVGV | 1.800 |
| 1029 | VLEQtLSPLW | 1.800 |
| 1821 | EAEFrQPAVL | 1.800 |
| 626 | GAEGpEIPRA | 1.800 |
| 1392 | IQDQgEAEVK | 1.500 |
| 267 | TSCPfYNEYF | 1.500 |
| 1360 | LQELqGQHNF | 1.350 |
| 1754 | LTGEmSSDIY | 1.250 |
| 340 | RMDLgIILDQ | 1.250 |
| 1344 | IPDPeELDWG | 1.250 |
| 266 | GTSCpFYNEY | 1.250 |
| 217 | HGDPfQVSRA | 1.250 |
| 1659 | SGDPeEAQAL | 1.250 |
| 1777 | ETDVhFNSLT | 1.250 |
| 1572 | IGEThIDLEN | 1.125 |
| 629 | GPEIpRAMEV | 1.125 |
| 181 | ENELeLELEQ | 1.125 |
| 1755 | TGEMsSDIYV | 1.125 |
| 1466 | YPESeAVLFS | 1.125 |
| 1661 | DPEEaQALLV | 1.125 |
| 1112 | AGELiAAFQL | 1.125 |
| 620 | HLDAsPGAEG | 1.000 |
| 841 | LVHSlNLLAK | 1.000 |
| 1313 | EAGIsRQLLK | 1.000 |
| 1481 | RGIPqNRPIK | 1.000 |
| 949 | ELFLrLGLGK | 1.000 |
| 1683 | QLVPeHVETR | 1.000 |
| 868 | VALAkKLLAK | 1.000 |
| 191 | DLDDePDVEL | 1.000 |
| 315 | GLTPpSPKAF | 1.000 |
| 1159 | NVCPvLREFR | 1.000 |
| 1349 | ELDWgSKYYA | 1.000 |
| 1121 | LIELdYSGRL | 0.900 |
| 917 | VVEEeRGRDC | 0.900 |
| 1927 | DLEFtDMGGN | 0.900 |
| 1578 | DLENrFYSHH | 0.900 |
| 689 | RLEEqLGRGS | 0.900 |
| 725 | EEELgTHAQR | 0.900 |
| 1952 | TVEEaEKRPV | 0.900 |
| 183 | ELELeLEQDL | 0.900 |
| 291 | LLEItVSGVG | 0.900 |
| 1184 | LLEVeQPQVV | 0.900 |
| 471 | SAEAaAPEWN | 0.900 |
| 1848 | SLELqLPDMV | 0.900 |
| 1164 | LREFrVEVLF | 0.900 |

TABLE X

158P3D2v.16, ORF: 65-6175,
Frame +2 A0201-9-mers
Each peptide is a portion of
SEQ ID NO: 29; each start position
is Specified, the length of the
peptide is 9 amino acids and the
end position for each peptide is
the start position plus eight.

| Pos | Subsequence | Score |
|---|---|---|
| 2010 | LLTVFLLLV | 1033.404 |
| 2005 | LLLLVLLTV | 1006.209 |
| 1490 | KLLVRVYVV | 849.359 |
| 451 | VLVEPYVRV | 727.166 |
| 873 | KLLAKLRFL | 699.907 |
| 1010 | GLSDPFARV | 541.810 |
| 1994 | FIWRRYWRT | 440.113 |
| 571 | LLLAVSMQV | 437.482 |
| 658 | LLFGVLFEA | 416.858 |
| 2014 | FLLLVFYTI | 337.376 |
| 98 | ALVDENLQV | 285.163 |
| 445 | ALHDQRVLV | 285.163 |
| 839 | KLLVHSLNL | 276.643 |
| 2009 | VLLTVFLLL | 255.302 |
| 2007 | LLVLLTVFL | 199.738 |
| 895 | WMLSGQRRV | 170.990 |
| 1155 | SLPPNVCPV | 159.970 |
| 2008 | LVLLTVFLL | 156.843 |
| 1984 | FVNPLKTFV | 153.971 |
| 971 | LLPEPSAGL | 148.896 |
| 1163 | VLREFRVEV | 140.004 |
| 2004 | VLLLLVLLT | 107.808 |
| 286 | RLQDLLLEI | 98.381 |
| 1845 | FLGSLELQL | 98.267 |
| 650 | VLAPCEDFL | 97.872 |
| 1243 | YLQPPLSIL | 92.666 |
| 234 | TVLEAQKLV | 92.322 |
| 840 | LLVHSLNLL | 83.527 |
| 1332 | GLLNQGPGL | 79.041 |
| 435 | RLGLLGSLV | 69.552 |
| 86 | QLQNAGHLV | 69.552 |
| 103 | NLQVSPIQV | 69.552 |
| 1710 | WIDIFPQDV | 66.867 |
| 781 | RLDQGLQEV | 63.988 |
| 1171 | VLFWGLRGL | 61.810 |

TABLE X-continued

158P3D2v.16, ORF: 65-6175,
Frame +2 A0201-9-mers
Each peptide is a portion of
SEQ ID NO: 29; each start position
is Specified, the length of the
peptide is 9 amino acids and the
end position for each peptide is
the start position plus eight.

| Pos | Subsequence | Score |
|---|---|---|
| 2 | ALTVSVQRL | 49.134 |
| 510 | ALATHVPDL | 49.134 |
| 79 | TLVISLQQL | 49.134 |
| 874 | LLAKLRFLA | 48.984 |
| 1041 | LLVFEQLIV | 48.478 |
| 1746 | VVLDDENPL | 48.205 |
| 437 | GLLGSLVRA | 42.278 |
| 1003 | VLAADDSGL | 36.316 |
| 847 | LLAKQGLRL | 36.316 |
| 572 | LLAVSMQVL | 34.246 |
| 553 | SLQGLNEGV | 34.080 |
| 406 | LLLPRGVPA | 31.249 |
| 1635 | KVGSKVFLT | 30.444 |
| 1756 | GEMSSDIYV | 27.521 |
| 1739 | VIWNTEDVV | 27.109 |
| 2003 | LVLLLLVLL | 27.042 |
| 802 | AQLKQALEV | 26.092 |
| 1464 | LIYPESEAV | 25.492 |
| 1463 | FLIYPESEA | 22.853 |
| 2021 | TIPGQISQV | 21.996 |
| 499 | QLRDDAPLV | 21.672 |
| 1082 | ALAAPRVKL | 21.362 |
| 430 | GLPALRLGL | 21.362 |
| 1747 | VLDDENPLT | 20.776 |
| 1571 | LIGETHIDL | 20.473 |
| 2002 | TLVLLLLVL | 20.145 |
| 931 | SLMLTAPGA | 18.382 |
| 1701 | GLLQGSLHM | 18.382 |
| 1033 | TLSPLWDEL | 17.795 |
| 291 | LLEITVSGV | 17.405 |
| 1306 | SLDPFLAEA | 17.368 |
| 438 | LLGSLVRAL | 16.705 |
| 549 | GLRDSLQGL | 15.310 |
| 1531 | YIPKQLNPI | 15.177 |
| 225 | RAQDFQVGV | 15.050 |

TABLE X-continued

158P3D2v.16, ORF: 65-6175,
Frame +2 A0201-9-mers
Each peptide is a portion of
SEQ ID NO: 29; each start position
is Specified, the length of the
peptide is 9 amino acids and the
end position for each peptide is
the start position plus eight.

| Pos | Subsequence | Score |
|---|---|---|
| 643 | LLPLPENVL | 14.890 |
| 498 | LQLRDDAPL | 13.624 |
| 1018 | VLISTQCQT | 12.668 |
| 1244 | LQPPLSILV | 11.988 |
| 63 | VQVVNCSRV | 11.988 |
| 1224 | VVFKDTAPL | 11.757 |
| 1938 | YILTGKVEA | 11.626 |
| 60 | CLSVQVVNC | 11.426 |
| 335 | RIGTFRMDL | 11.162 |
| 1040 | ELLVFEQLI | 11.001 |
| 184 | LELELEQDL | 10.712 |
| 328 | TLPFMATRI | 10.433 |
| 1703 | LQGSLHMWI | 9.890 |
| 1055 | HLQEEPPLV | 9.696 |
| 215 | LAHGDPFQV | 9.525 |
| 642 | ELLPLPENV | 9.457 |
| 1852 | QLPDMVRGA | 9.370 |
| 1261 | TVLVGSHIV | 9.232 |
| 1113 | GELIAAFQL | 8.914 |
| 1614 | ILAGLCQRC | 8.446 |
| 1639 | KVFLTPPET | 8.444 |
| 2001 | RTLVLLLLV | 8.221 |
| 1193 | VLEVAGQGV | 7.567 |
| 1184 | LLEVEQPQV | 7.567 |
| 1683 | QLVPEHVET | 7.452 |
| 654 | CEDFLLFGV | 7.216 |
| 1557 | TVAVFDHDL | 7.103 |
| 638 | VEVEELLPL | 6.659 |
| 867 | KVALAKKLL | 6.542 |
| 888 | PLPDVLVWM | 5.669 |

TABLE XI

158P3D2v.17, ORF: 65-6175,
Frame +2, A0201-10-mers
Each peptide is a portion of
SEQ ID NO: 29; each start position
is Specified, the length of the
peptide is 10 amino acids and the
end position for each peptide is
the start position plus nine.

| Pos | Subsequence | Score |
|---|---|---|
| 290 | LLLEiTVSGV | 4125.456 |
| 2009 | VLLTvFLLLV | 3823.593 |
| 276 | FLFEfHDTRL | 1490.711 |
| 657 | FLLFgVLFEA | 1127.969 |
| 2004 | VLLLlVLLTV | 1006.209 |
| 2006 | LLLVlLTVFL | 739.032 |
| 839 | KLLVhSLNLL | 636.279 |
| 2007 | LLVLlTVFLL | 484.457 |
| 214 | ALAHgDPFQV | 403.402 |
| 880 | FLAEePQPPL | 402.895 |
| 873 | KLLAkLRFLA | 373.146 |
| 1243 | YLQPpLSILV | 319.939 |
| 1801 | YLPTeREVSV | 319.939 |
| 461 | FLGQeGETSV | 319.939 |
| 570 | RLLLaVSMQV | 257.342 |
| 650 | VLAPcEDFLL | 210.633 |
| 1319 | QLLKpPLKKL | 181.794 |
| 2012 | TVFLlLVFYT | 177.011 |
| 1178 | GLGRvHLLEV | 159.970 |
| 1192 | VVLEvAGQGV | 156.947 |
| 1463 | FLIYpESEAV | 156.770 |
| 571 | LLLAvSMQVL | 126.710 |
| 1702 | LLQGsLHMWI | 97.547 |
| 846 | NLLAkQGLRL | 79.041 |
| 1986 | NPLKtFVFFI | 70.254 |
| 1549 | SLPAeTELTV | 69.552 |
| 1028 | RVLEsITLSPL | 65.219 |
| 241 | LVGVnINPYV | 56.902 |
| 869 | ALAKkLLAKL | 49.134 |
| 2002 | TLVLlLLVLL | 49.134 |
| 810 | VLVAgSRQFC | 46.451 |
| 498 | LQLRdDAPLV | 44.356 |
| 658 | LLFGvLFEAT | 43.639 |
| 556 | GLNEgVGQGI | 42.774 |
| 1734 | YELRvVIWNT | 42.542 |

TABLE XI-continued

158P3D2v.17, ORF: 65-6175,
Frame +2, A0201-10-mers
Each peptide is a portion of
SEQ ID NO: 29; each start position
is Specified, the length of the
peptide is 10 amino acids and the
end position for each peptide is
the start position plus nine.

| Pos | Subsequence | Score |
|---|---|---|
| 65 | VVNCsRVFSL | 42.390 |
| 1994 | FIWRrYWRTL | 38.130 |
| 437 | GLLGsLVRAL | 36.359 |
| 1183 | HLLEvEQPQV | 35.874 |
| 760 | SCWEdHTWRL | 35.591 |
| 222 | QVSRaQDFQV | 35.298 |
| 450 | RVLVePYVRV | 33.776 |
| 888 | PLPDvLVWML | 33.239 |
| 157 | AQLErRAVAL | 32.857 |
| 1010 | GLSDpFARVL | 27.292 |
| 777 | KVAErLDQGL | 26.823 |
| 85 | QQLQnAGHLV | 26.092 |
| 564 | GIWFrGRLLL | 24.380 |
| 203 | VMFSpLKSRA | 22.569 |
| 2008 | LVLLtVFLLL | 22.339 |
| 1944 | VEAEfELLTV | 21.680 |
| 497 | RLQLrDDAPL | 21.362 |
| 844 | SLNLlAKQGL | 21.362 |
| 1809 | SVWRrSGPFA | 19.844 |
| 991 | FQLRaHLYQA | 19.718 |
| 1491 | LLVRvYVVKA | 19.425 |
| 649 | NVLApCEDFL | 18.639 |
| 405 | NLLLpRGVPA | 18.382 |
| 1455 | LVGKfKGSFL | 17.477 |
| 235 | VLEAqKLVGV | 17.405 |
| 1739 | VIWNtEDVVL | 16.993 |
| 1746 | VVLDdENPLT | 16.816 |
| 847 | LLAKqGLRLL | 16.705 |
| 1795 | FVFRfDYLPT | 16.647 |
| 1535 | QLNPiFGEIL | 16.308 |
| 1825 | RQPAvLVLQV | 16.219 |
| 424 | RLYRaEGLPA | 15.898 |
| 1305 | KSLDpFLAEA | 15.049 |
| 1833 | QVWDyDRISA | 14.793 |
| 1668 | LLVLrRWQEM | 14.358 |
| 286 | RLQDlLLEIT | 14.118 |
| 295 | TVSGvGVTSV | 13.997 |
| 12 | GLTGtHDRQV | 13.910 |
| 352 | GQFYqRWVPL | 13.624 |
| 1831 | VLQVwDYDRI | 13.036 |
| 1018 | VLIStQCQTT | 12.668 |
| 1639 | KVFLtPPETL | 11.861 |
| 530 | FNPTfGPAWV | 11.487 |
| 1115 | LIAAfQLIEL | 11.485 |
| 1082 | ALAApRVKLM | 11.426 |
| 1033 | TLSPlWDELL | 10.468 |
| 908 | IPAQdVLFSV | 10.296 |
| 2020 | YTIPgQISQV | 10.220 |
| 1427 | FEDWlNVFPL | 10.196 |
| 1047 | LIVDgRREHL | 10.032 |
| 245 | NINPyVAVQV | 9.563 |
| 143 | IIPNvGFQEL | 9.488 |
| 2003 | LVLLlLVLLT | 9.433 |
| 1771 | LEHDkQETDV | 9.426 |
| 243 | GVNInPYVAV | 9.129 |
| 453 | VEPYvRVSFL | 8.933 |
| 175 | GQQDdEENEL | 8.880 |
| 1155 | SLPPnVCPVL | 8.759 |
| 86 | QLQNaGHLVL | 8.759 |
| 1676 | EMPGfGIQLV | 8.665 |
| 832 | ALDRcRGKLL | 8.545 |
| 643 | LLPLpENVLA | 8.446 |
| 840 | LLVHsLNLLA | 8.446 |
| 1040 | ELLVfEQLIV | 7.913 |
| 72 | FSLRpLGTLV | 7.727 |

TABLE XII

158P3D2v.17, ORF: 65-6175,
Frame +2, A3-9-mers
Each peptide is a portion of
SEQ ID NO: 29; each start position
is Specified, the length of the
peptide is 9 amino acids; and the
end position for each peptide is
the start position plus eight.i;

| Pos | Subsequence | Score |
|---|---|---|
| 1319 | QLLKPPLKK | 90.000 |
| 276 | FLFEFHDTR | 90.000 |
| 1089 | KLMEDPYQR | 81.000 |
| 869 | ALAKKLLAK | 60.000 |
| 858 | GLRRNVQK | 60.000 |
| 1829 | VLVLQVWDY | 54.000 |
| 1989 | KTFVFFIWR | 54.000 |
| 1491 | LLVRVYVVK | 45.000 |
| 1099 | ELQFFPLRK | 36.000 |
| 1831 | VLQVWDYDR | 36.000 |
| 1757 | EMSSDIYVK | 27.000 |
| 1430 | WLNVFPLYR | 24.000 |
| 203 | VMFSPLKSR | 22.500 |
| 304 | VLQRRGDEK | 20.000 |
| 953 | RLGLGKQAK | 20.000 |
| 1950 | LLTVEEAEK | 20.000 |
| 23 | LTFRGFTQK | 15.000 |
| 2014 | FLLLVFYTI | 12.150 |
| 982 | SLHRDDFSY | 12.000 |
| 1310 | FLAEAGISR | 12.000 |
| 658 | LLFGVLFEA | 10.125 |
| 599 | RLTRKKKKK | 10.000 |
| 1761 | DIYVKSWVK | 9.000 |
| 1706 | SLHMWIDIF | 9.000 |
| 1419 | SLKEEFNHF | 9.000 |
| 1490 | KLLVRVYVV | 8.100 |
| 2009 | VLLTVFLLL | 8.100 |
| 2028 | QVIFRPLHK | 6.000 |
| 1064 | IINVFDHNK | 6.000 |
| 232 | GVTVLEAQK | 6.000 |
| 1482 | GIPQNRPIK | 6.000 |
| 560 | GVGQGIWFR | 5.400 |
| 839 | KLLVHSLNL | 5.400 |
| 2006 | LLLVLLTVF | 4.500 |
| 768 | RLQSSNCVR | 4.000 |
| 852 | GLRLLRGLR | 3.600 |
| 1864 | ELCSVQLAR | 3.600 |
| 1850 | ELQLPDMVR | 3.600 |
| 430 | GLPALRLGL | 3.600 |
| 2024 | GQISQVIFR | 3.240 |
| 1767 | WVKGLEHDK | 3.000 |
| 1036 | PLWDELLVF | 3.000 |
| 2012 | TVFLLLVFY | 3.000 |
| 1399 | EVKGTVSPK | 2.700 |
| 1623 | GLPAPEYRA | 2.700 |
| 1332 | GLLNQGPGL | 2.700 |
| 2002 | TLVLLLLVL | 2.700 |
| 549 | GLRDSLQGL | 2.700 |
| 300 | GVTSVLQRR | 2.700 |
| 1010 | GLSDPFARV | 2.700 |
| 1932 | DMGGNVYIL | 2.430 |
| 1247 | PLSILVIER | 2.400 |
| 595 | STLSRLTRK | 2.250 |
| 1243 | YLQPPLSIL | 2.025 |
| 437 | GLLGSLVRA | 2.025 |
| 327 | QTLPFMATR | 2.025 |
| 1880 | NLFRCRRLR | 2.000 |
| 596 | TLSRLTRKK | 2.000 |
| 2 | ALTVSVQRL | 1.800 |
| 635 | AMEVEVEEL | 1.800 |
| 1701 | GLLQGSLHM | 1.800 |
| 2010 | LLTVFLLLV | 1.800 |
| 450 | RVLVEPYVR | 1.800 |
| 846 | NLLAKQGLR | 1.800 |
| 1684 | LVPEHVETR | 1.800 |
| 510 | ALATHVPDL | 1.800 |
| 286 | RLQDLLLEI | 1.800 |
| 864 | VQKKVALAK | 1.800 |
| 899 | GQRRVAWAR | 1.620 |

TABLE XII-continued

158P3D2v.17, ORF: 65-6175,
Frame +2, A3-9-mers
Each peptide is a portion of
SEQ ID NO: 29; each start position
is Specified, the length of the
peptide is 9 amino acids; and the
end position for each peptide is
the start position plus eight.i;

| Pos | Subsequence | Score |
|---|---|---|
| 1676 | EMPGFGIQL | 1.620 |
| 1987 | PLKTFVFFI | 1.620 |
| 141 | ELIIPNVGF | 1.350 |
| 315 | GLTPPSPKA | 1.350 |
| 1267 | HIVPHMLRF | 1.350 |
| 1145 | PLVEPHSGR | 1.350 |
| 971 | LLPEPSAGL | 1.350 |
| 840 | LLVHSLNLL | 1.350 |
| 79 | TLVISLQQL | 1.350 |
| 2005 | LLLLVLLTV | 1.350 |
| 1306 | SLDPFLAEA | 1.350 |
| 1535 | QLNPIFGEI | 1.215 |
| 284 | RLRLQDLLL | 1.200 |
| 1845 | FLGSLELQL | 1.200 |
| 847 | LLAKQGLRL | 1.200 |
| 1889 | GWWPVVKLK | 1.013 |
| 1320 | LLKPPLKKL | 1.012 |
| 854 | RLLRGLRRR | 0.900 |
| 1526 | DTKERYIPK | 0.900 |
| 1029 | VLEQTLSPL | 0.900 |
| 643 | LLPLPENVL | 0.900 |
| 420 | RLRVRLYRA | 0.900 |
| 571 | LLLAVSMQV | 0.900 |
| 650 | VLAPCEDFL | 0.900 |
| 1033 | TLSPLWDEL | 0.900 |
| 939 | AAPGEVCAK | 0.900 |
| 337 | GTFRMDLGI | 0.900 |
| 1318 | RQLLKPPLK | 0.900 |
| 992 | QLRAHLYQA | 0.900 |
| 996 | HLYQARGVL | 0.900 |
| 331 | FMATRIGTF | 0.900 |

TABLE XIII

158P3D2v.17, ORF: 65-6175,
Frame +2, A3-10-mers
Each peptide is a portion of
SEQ ID NO: 29; each start position
is Specified, the length of the
peptide is 10 amino acids and the
end position for each peptide is
the start position plus nine.

| Pos | Subsequence | Score |
|---|---|---|
| 858 | GLRRrNVQKK | 180.000 |
| 22 | KLTFrGFTQK | 180.000 |
| 1490 | KLLVrVYVVK | 135.000 |
| 1886 | RLRGwWPVVK | 90.000 |
| 949 | ELFLrLGLGK | 60.000 |
| 1472 | VLFSePQISR | 60.000 |
| 1989 | KTFVfFIWRR | 40.500 |
| 240 | KLVGvNINPY | 40.500 |
| 785 | GLQEvERLQR | 36.000 |
| 1502 | NLAPaDPNGK | 30.000 |
| 913 | VLFSvVEEER | 30.000 |
| 714 | LLGArPEEEK | 30.000 |
| 1683 | QLVPeHVETR | 27.000 |
| 852 | GLRLlRGLRR | 24.000 |
| 1412 | TLKIyNRSLK | 20.000 |
| 768 | RLQSsNCVRK | 20.000 |
| 1895 | KLKEaEDVER | 18.000 |
| 596 | TLSRlTRKKK | 10.000 |
| 1949 | ELLTvEEAEK | 9.000 |
| 1063 | VIINvFDHNK | 9.000 |
| 1120 | QLIElDYSGR | 9.000 |
| 1296 | MMPKgPQGQK | 9.000 |
| 2007 | LLVLlTVELL | 8.100 |
| 826 | TMTRpNALDR | 8.000 |
| 435 | RLGLlGSLVR | 8.000 |
| 298 | GVGVtSVLQR | 7.200 |
| 2010 | LLTVfLLLVF | 6.000 |
| 510 | ALAThVPDLR | 6.000 |
| 863 | NVQKkVALAK | 6.000 |
| 407 | LLPRgVPAER | 6.000 |
| 1218 | LVRHlTVVFK | 6.000 |
| 441 | SLVRaLHDQR | 6.000 |
| 331 | FMATrIGTFR | 6.000 |
| 841 | LVHSlNLLAK | 6.000 |
| 982 | SLHRdDFSYF | 6.000 |

TABLE XIII-continued

158P3D2v.17, ORF: 65-6175,
Frame +2, A3-10-mers
Each peptide is a portion of
SEQ ID NO: 29; each start position
is Specified, the length of the
peptide is 10 amino acids and the
end position for each peptide is
the start position plus nine.

| Pos | Subsequence | Score |
|---|---|---|
| 1828 | AVLVlQVWDY | 5.400 |
| 1830 | LVLQvWDYDR | 5.400 |
| 315 | GLTPpSPKAF | 4.500 |
| 276 | FLFEfHDTRL | 4.500 |
| 1939 | ILTGkVEAEF | 4.500 |
| 2005 | LLLLvLLTVF | 4.500 |
| 1454 | HLVGkFKGSF | 4.050 |
| 839 | KLLVhSLNLL | 4.050 |
| 556 | GLNEgVGQGI | 4.050 |
| 1950 | LLTVeEAEKR | 4.000 |
| 1078 | FLGRaLAAPR | 4.000 |
| 992 | QLRAhLYQAR | 4.000 |
| 346 | ILDQpDGQFY | 4.000 |
| 947 | KLELfLRLGL | 3.600 |
| 411 | GVPAeRPWAR | 3.600 |
| 303 | SVLQrRGDEK | 3.000 |
| 2009 | VLLTvFLLLV | 2.700 |
| 938 | GAAPgEVCAK | 2.700 |
| 1535 | QLNPIFGEIL | 2.700 |
| 650 | VLAPcEDFLL | 2.700 |
| 1491 | LLVRvYVVKA | 2.700 |
| 1318 | RQLLkPPLKK | 2.700 |
| 1200 | GVESeVLASY | 2.700 |
| 873 | KLLAkLRFLA | 2.700 |
| 1055 | HLQEePPLVI | 2.700 |
| 1163 | VLREfRVEVL | 2.700 |
| 1175 | GLRGlGRVHL | 2.700 |
| 1033 | TLSPlWDELL | 2.700 |
| 658 | LLFGvLFEAT | 2.250 |
| 202 | GVMFsPLKSR | 2.025 |
| 657 | FLLFgVLFEA | 2.025 |
| 424 | RLYRaEGLPA | 2.000 |
| 893 | LVWMlSGQRR | 2.000 |
| 846 | NLLAkQGLRL | 1.800 |

TABLE XIII-continued

158P3D2v.17, ORF: 65-6175,
Frame +2, A3-10-mers
Each peptide is a portion of
SEQ ID NO: 29; each start position
is Specified, the length of the
peptide is 10 amino acids and the
end position for each peptide is
the start position plus nine.

| Pos | Subsequence | Score |
|---|---|---|
| 892 | VLVWmLSGQR | 1.800 |
| 73 | SLRPlGTLVI | 1.800 |
| 1852 | QLPDmVRGAR | 1.800 |
| 2027 | SQVIfRPLHK | 1.800 |
| 266 | GTSCpFYNEY | 1.800 |
| 1178 | GLGRvHLLEV | 1.800 |
| 1409 | AVATlKIYNR | 1.800 |
| 1702 | LLQGsLHMWI | 1.800 |
| 564 | GIWFrGRLLL | 1.800 |
| 807 | ALEVlVAGSR | 1.800 |
| 880 | FLAEePQPPL | 1.350 |
| 1639 | KVFLtPPETL | 1.350 |
| 571 | LLLAvSMQVL | 1.350 |
| 290 | LLLEiTVSGV | 1.350 |
| 1399 | EVKGtVSPKK | 1.350 |
| 45 | ELFRwPHYGA | 1.350 |
| 1701 | GLLQgSLHMW | 1.350 |
| 1718 | VPAPpPVDIK | 1.350 |
| 1155 | SLPPnVCPVL | 1.350 |
| 2004 | VLLLlVLLTV | 1.350 |
| 2002 | TLVLlLLVLL | 1.350 |
| 437 | GLLGsLVRAL | 1.215 |
| 1756 | GEMSsDIYVK | 1.215 |
| 1617 | GLCQrCGLPA | 1.200 |
| 1869 | QLARnGAGPR | 1.200 |
| 485 | FVELfPPLTR | 1.200 |
| 86 | QLQNaGHLVL | 1.200 |
| 517 | DLRRiSHPGR | 1.200 |
| 1319 | QLLKpPLKKL | 1.012 |
| 1224 | VVFKdTAPLF | 1.000 |
| 13 | LTGThDRQVK | 1.000 |

TABLE XIV

158P3D2v.17, ORF: 65-6175, Frame +2, A1101-9-mers
Each peptide is a portion of SEQ ID NO: 29; each start position is Specified, the length of the peptide is 9 amino acids and the end position for each peptide is the start position plus eight.

| Pos | Subsequence | Score |
| --- | --- | --- |
| 2028 | QVIFRPLHK | 6.000 |
| 232 | GVTVLEAQK | 6.000 |
| 450 | RVLVEPYVR | 3.600 |
| 1318 | RQLLKPPLK | 2.700 |
| 560 | GVGQGIWFR | 2.400 |
| 1989 | KTFVFFIWR | 2.400 |
| 23 | LTFRGFTQK | 2.000 |
| 1767 | WVKGLEHDK | 2.000 |
| 368 | RAGTKGFIK | 1.800 |
| 595 | STLSRLTRK | 1.500 |
| 953 | RLGLGKQAK | 1.200 |
| 858 | GLRRRNVQK | 1.200 |
| 864 | VQKKVALAK | 1.200 |
| 1319 | QLLKPPLKK | 1.200 |
| 300 | GVTSVLQRR | 1.200 |
| 1482 | GIPQNRPIK | 1.200 |
| 2024 | GQISQVIFR | 1.080 |
| 1089 | KLMEDPYQR | 0.960 |
| 869 | ALAKKLLAK | 0.800 |
| 893 | LVWMLSGQR | 0.800 |
| 816 | RQFCHGAER | 0.720 |
| 899 | GQRRVAWAR | 0.720 |
| 769 | LQSSNCVRK | 0.600 |
| 1399 | EVKGTVSPK | 0.600 |
| 599 | RLTRKKKKK | 0.600 |
| 950 | LFLRLGLGK | 0.600 |
| 797 | GPGACAQLK | 0.600 |
| 607 | KARRDQTPK | 0.600 |
| 1906 | AQEAQAGKK | 0.600 |
| 1526 | DTKERYIPK | 0.600 |
| 1491 | LLVRVYVVK | 0.600 |
| 1761 | DIYVKSWVK | 0.480 |
| 512 | ATHVPDLRR | 0.400 |
| 1684 | LVPEHVETR | 0.400 |
| 827 | MTRPNALDR | 0.400 |
| 304 | VLQRRGDEK | 0.400 |
| 1950 | LLTVEEAEK | 0.400 |
| 62 | SVQVVNCSR | 0.400 |
| 1064 | IINVFDHNK | 0.400 |
| 251 | AVQVGGQRR | 0.400 |
| 442 | LVRALHDQR | 0.400 |
| 1729 | RQPISYELR | 0.360 |
| 327 | QTLPFMATR | 0.300 |
| 745 | FCLPLCHCK | 0.300 |
| 1951 | LTVEEAEKR | 0.300 |
| 1909 | AQAGKKKRK | 0.300 |
| 1757 | EMSSDIYVK | 0.240 |
| 786 | LQEVERLQR | 0.240 |
| 591 | AQQGSTLSR | 0.240 |
| 1099 | ELQFFPLRK | 0.240 |
| 852 | GLRLLRGLR | 0.240 |
| 1665 | AQALLVLRR | 0.240 |
| 768 | RLQSSNCVR | 0.240 |
| 821 | GAERRTMTR | 0.240 |
| 626 | GAEGPEIPR | 0.240 |
| 939 | AAPGEVCAK | 0.200 |
| 1297 | MPKGPQGQK | 0.200 |
| 1503 | LAPADPNGK | 0.200 |
| 1935 | GNVYILTGK | 0.180 |
| 1430 | WLNVFPLYR | 0.160 |
| 1831 | VLQVWDYDR | 0.160 |
| 1310 | FLAEAGISR | 0.160 |
| 276 | FLFEFHDTR | 0.160 |
| 26 | RGFTQKTRK | 0.120 |
| 1965 | RKQPEPLEK | 0.120 |
| 337 | GTFRMDLGI | 0.120 |
| 376 | KVTLSVRAR | 0.120 |
| 1798 | RFDYLPTER | 0.120 |
| 1168 | RVEVLFWGL | 0.120 |

TABLE XIV-continued

158P3D2v.17, ORF: 65-6175,
Frame +2, A1101-9-mers
Each peptide is a portion of
SEQ ID NO: 29; each start position
is Specified, the length of the
peptide is 9 amino acids and the
end position for each peptide is
the start position plus eight.

| Pos | Subsequence | Score |
|---|---|---|
| 427 | RAEGLPALR | 0.120 |
| 1878 | RCNLFRCRR | 0.120 |
| 243 | GVNINPYVA | 0.120 |
| 902 | RVAWARIPA | 0.120 |
| 1598 | EVDGYNAWR | 0.120 |
| 945 | CAKLELFLR | 0.120 |
| 164 | VALGRRLAR | 0.120 |
| 1990 | TFVFFIWRR | 0.120 |
| 1993 | FFIWRRYWR | 0.120 |
| 846 | NLLAKQGLR | 0.120 |
| 1613 | QILAGLCQR | 0.120 |
| 661 | GVLFEATMI | 0.090 |
| 1081 | RALAAPRVK | 0.090 |
| 2008 | LVLLTVFLL | 0.090 |
| 1062 | LVIINVFDH | 0.090 |
| 2001 | RTLVLLLLV | 0.090 |
| 787 | QEVERLQRK | 0.090 |
| 1121 | LIELDYSGR | 0.080 |
| 203 | VMFSPLKSR | 0.080 |
| 760 | SCWEDHTWR | 0.080 |
| 412 | VPAERPWAR | 0.080 |
| 1410 | VATLKIYNR | 0.080 |
| 1473 | LFSEPQISR | 0.080 |
| 1212 | SPNFTELVR | 0.080 |
| 349 | QPDGQFYQR | 0.080 |
| 374 | FIKVTLSVR | 0.080 |
| 1981 | FNWFVNPLK | 0.080 |
| 1958 | KRPVGKGRK | 0.060 |
| 1314 | AGISRQLLK | 0.060 |
| 1889 | GWWPVVKLK | 0.060 |
| 1087 | RVKLMEDPY | 0.060 |

TABLE XV

158P3D2v.17, ORF: 65-6175,
Frame +2, A1101-10-mers
Each peptide is a portion of
SEQ ID NO: 29 each start position
is Specified, the length of the
peptide is 10 amino acids and the
end position for each peptide is
the start position plus nine.

| Pos | Subsequence | Score |
|---|---|---|
| 1318 | RQLLkPPLKK | 5.400 |
| 841 | LVHSlNLLAK | 4.000 |
| 863 | NVQKkVALAK | 4.000 |
| 303 | SVLQrRGDEK | 3.000 |
| 298 | GVGVtSVLQR | 2.400 |
| 411 | GVPAeRPWAR | 2.400 |
| 1989 | KTFVfFIWRR | 2.400 |
| 1218 | LVRHlVVFK | 2.000 |
| 2027 | SQVIfRPLHK | 1.800 |
| 1490 | KLLVrVYVVK | 1.800 |
| 1886 | RLRGwWPVVK | 1.200 |
| 202 | GVMFsPLKSR | 1.200 |
| 768 | RLQSsNCVRK | 1.200 |
| 1168 | RVEVlFWGLR | 1.200 |
| 858 | GLRRrNVQKK | 1.200 |
| 22 | KLTFrGFTQK | 1.200 |
| 1830 | LVLQvWDYDR | 1.200 |
| 13 | LTGThDRQVK | 1.000 |
| 893 | LVWMlSGQRR | 0.800 |
| 1409 | AVATlKIYNR | 0.800 |
| 163 | AVALgRRLAR | 0.800 |
| 485 | FVELfPPLTR | 0.800 |
| 816 | RQFChGAERR | 0.720 |
| 1756 | GEMSsDIYVK | 0.720 |
| 1063 | VIINvFDHNK | 0.600 |
| 864 | VQKKvALAKK | 0.600 |
| 938 | GAAPgEVCAK | 0.600 |
| 868 | VALAkKLLAK | 0.600 |
| 786 | LQEVeRLQRK | 0.600 |
| 1392 | IQDQgEAEVK | 0.600 |
| 1630 | RAGAvKVGSK | 0.600 |
| 1399 | EVKGtVSPKK | 0.600 |
| 785 | GLQEvERLQR | 0.480 |
| 435 | RLGLlGSLVR | 0.480 |
| 949 | ELFLrLGLGK | 0.480 |

TABLE XV-continued

158P3D2v.17, ORF: 65-6175,
Frame +2, A1101-10-mers
Each peptide is a portion of
SEQ ID NO: 29 each start position
is Specified, the length of the
peptide is 10 amino acids and the
end position for each peptide is
the start position plus nine.

| Pos | Subsequence | Score |
|---|---|---|
| 852 | GLRLlRGLRR | 0.480 |
| 249 | YVAVqVGGQR | 0.400 |
| 714 | LLGArPEEEK | 0.400 |
| 1296 | MMPKgPQGQK | 0.400 |
| 574 | AVSMqVLEGR | 0.400 |
| 1412 | TLKIyNRSLK | 0.400 |
| 1159 | NVCPvLREFR | 0.400 |
| 1502 | NLAPaDPNGK | 0.400 |
| 395 | APGHcSDIEK | 0.400 |
| 256 | GQRRvTATQR | 0.360 |
| 1472 | VLFSePQISR | 0.320 |
| 1906 | AQEAqAGKKK | 0.300 |
| 107 | SPIQvELDLK | 0.300 |
| 1895 | KLKEaEDVER | 0.240 |
| 1072 | KFGPpVFLGR | 0.240 |
| 1874 | GAGPrCNLFR | 0.240 |
| 1980 | SFNWfVNPLK | 0.200 |
| 10 | LTGLtGTHDR | 0.200 |
| 492 | LTRSlRLQLR | 0.200 |
| 596 | TLSRlTRKKK | 0.200 |
| 744 | YFCLpLCHCK | 0.200 |
| 1519 | SAGReRQDTK | 0.200 |
| 1626 | APEYrAGAVK | 0.200 |
| 313 | AAGLtPPSPK | 0.200 |
| 1785 | LTGEgNFNWR | 0.200 |
| 1718 | VPAPpPVDIK | 0.200 |
| 1405 | SPKKaVATLK | 0.200 |
| 373 | GFIKvTLSVR | 0.180 |
| 1612 | SQILaGLCQR | 0.180 |
| 1949 | ELLTvEEAEK | 0.180 |
| 1904 | REAQeAQAGK | 0.180 |
| 1172 | LFWGlRGLGR | 0.160 |
| 1992 | VFFIwRRYWR | 0.160 |
| 913 | VLFSvVEEER | 0.160 |

TABLE XV-continued

158P3D2v.17, ORF: 65-6175,
Frame +2, A1101-10-mers
Each peptide is a portion of
SEQ ID NO: 29 each start position
is Specified, the length of the
peptide is 10 amino acids and the
end position for each peptide is
the start position plus nine.

| Pos | Subsequence | Score |
|---|---|---|
| 826 | TMTRpNALDR | 0.160 |
| 595 | STLSrLTRKK | 0.150 |
| 1964 | GRKQpEPLEK | 0.120 |
| 944 | VCAKlELFLR | 0.120 |
| 1290 | MEETgDMMPK | 0.120 |
| 892 | VLVWmLSGQR | 0.120 |
| 87 | LQNAgHLVLR | 0.120 |
| 1621 | RCGLpAPEYR | 0.120 |
| 867 | KVALaKKLLA | 0.120 |
| 1494 | RVYVvKATNL | 0.120 |
| 1313 | EAGIsRQLLK | 0.120 |
| 1120 | QLIElDYSGR | 0.120 |
| 326 | SQTLpFMATR | 0.120 |
| 1639 | KVFLtPPETL | 0.120 |
| 1097 | RPELqFFPLR | 0.120 |
| 1683 | QLVPeHVETR | 0.120 |
| 441 | SLVRaLHDQR | 0.120 |
| 600 | LTRKkKKKAR | 0.100 |
| 1481 | RGIPqNRPIK | 0.090 |
| 857 | RGLRrRNVQK | 0.090 |
| 2001 | RTLVlLLLVL | 0.090 |
| 1002 | GVLAaDDSGL | 0.090 |
| 1737 | RVVIwNTEDV | 0.090 |
| 1028 | RVLEqTLSPL | 0.090 |
| 450 | RVLVePYVRV | 0.090 |
| 1251 | LVIErRAFGH | 0.090 |
| 1398 | AEVKgTVSPK | 0.090 |
| 407 | LLPRgVPAER | 0.080 |
| 1950 | LLTVeEAEKR | 0.080 |
| 510 | ALAThVPDLR | 0.080 |
| 331 | FMATrIGTFR | 0.080 |

TABLE XVI

158P3D2v.17, ORF: 65-6175,
Frame +2, A24-9-mers
Each peptide is a portion of
SEQ ID NO: 29; each start position
is Specified, the length of the
peptide is 9 amino acids and the
end position for each peptide is
the start position plus eight.

| Pos | Subsequence | Score |
|---|---|---|
| 1355 | KYYASLQEL | 528.000 |
| 1998 | RYWRTLVLL | 400.000 |
| 1465 | IYPESEAVL | 360.000 |
| 1495 | VYVVKATNL | 300.000 |
| 1694 | LYHPHSPGL | 240.000 |
| 989 | SYFQLRAHL | 240.000 |
| 1601 | GYNAWRDAF | 150.000 |
| 1794 | RFVFRFDYL | 72.000 |
| 484 | SFVELFPPL | 51.840 |
| 488 | LFPPLTRSL | 43.200 |
| 1980 | SFNWFVNPL | 36.000 |
| 277 | LFEFHDTRL | 30.000 |
| 1423 | EFNHFEDWL | 30.000 |
| 1640 | VFLTPPETL | 30.000 |
| 228 | DFQVGVTVL | 30.000 |
| 1214 | NFTELVRHL | 28.800 |
| 533 | TFGPAWVPL | 24.000 |
| 279 | EFHDTRLRL | 24.000 |
| 1426 | HFEDWLNVF | 21.600 |
| 353 | QFYQRWVPL | 20.000 |
| 116 | KYQPPEGAT | 18.000 |
| 1168 | RVEVLFWGL | 17.280 |
| 656 | DFLLFGVLF | 15.000 |
| 1983 | WFVNPLKTF | 15.000 |
| 1094 | PYQRPELQF | 15.000 |
| 162 | RAVALGRRL | 14.400 |
| 1097 | RPELQFFPL | 14.400 |
| 825 | RTMTRPNAL | 14.400 |
| 1943 | KVEAEFELL | 14.400 |
| 1107 | KGPWAAGEL | 13.200 |
| 1322 | KPPLKKLPL | 12.000 |
| 48 | RWPHYGAPL | 12.000 |
| 873 | KLLAKLRFL | 12.000 |
| 839 | KLLVHSLNL | 12.000 |
| 862 | RNVQKKVAL | 12.000 |

TABLE XVI-continued

158P3D2v.17, ORF: 65-6175,
Frame +2, A24-9-mers
Each peptide is a portion of
SEQ ID NO: 29; each start position
is Specified, the length of the
peptide is 9 amino acids and the
end position for each peptide is
the start position plus eight.

| Pos | Subsequence | Score |
|---|---|---|
| 1225 | VFKDTAPLF | 12.000 |
| 1177 | RGLGRVHLL | 12.000 |
| 444 | RALHDQRVL | 12.000 |
| 1299 | KGPQGQKSL | 12.000 |
| 2026 | ISQVIFRPL | 10.080 |
| 2009 | VLLTVFLLL | 10.080 |
| 323 | AFHSQTLPF | 10.000 |
| 1800 | DYLPTEREV | 9.900 |
| 308 | RGDEKAAGL | 9.600 |
| 686 | RAGRLEEQL | 9.600 |
| 837 | RGKLLVHSL | 9.600 |
| 144 | IPNVGFQEL | 9.504 |
| 1888 | RGWWPVVKL | 8.800 |
| 778 | VAERLDQGL | 8.640 |
| 1746 | VVLDDENPL | 8.640 |
| 1542 | EILELSISL | 8.640 |
| 297 | SGVGVTSVL | 8.400 |
| 107 | SPIQVELDL | 8.400 |
| 503 | DAPLVDAAL | 8.400 |
| 1156 | LPPNVCPVL | 8.400 |
| 384 | RGDLPPPML | 8.000 |
| 284 | RLRLQDLLL | 8.000 |
| 867 | KVALAKKLL | 8.000 |
| 335 | RIGTFRMDL | 8.000 |
| 1963 | KGRKQPEPL | 8.000 |
| 1548 | ISLPAETEL | 7.920 |
| 233 | VTVLEAQKL | 7.920 |
| 1242 | PYLQPPLSI | 7.500 |
| 1596 | QYEVDGYNA | 7.500 |
| 997 | LYQARGVLA | 7.500 |
| 1733 | SYELRVVIW | 7.500 |
| 105 | QVSPIQVEL | 7.392 |
| 940 | APGEVCAKL | 7.392 |
| 643 | LLPLPENVL | 7.200 |

TABLE XVI-continued

158P3D2v.17, ORF: 65-6175,
Frame +2, A24-9-mers
Each peptide is a portion of
SEQ ID NO: 29; each start position
is Specified, the length of the
peptide is 9 amino acids and the
end position for each peptide is
the start position plus eight.

| Pos | Subsequence | Score |
| --- | --- | --- |
| 845 | LNLLAKQGL | 7.200 |
| 1240 | EQPYLQPPL | 7.200 |
| 1230 | APLFHPQDL | 7.200 |
| 1243 | YLQPPLSIL | 7.200 |
| 2007 | LLVLLTVFL | 7.200 |
| 1841 | SANDFLGSL | 7.200 |
| 840 | LLVHSLNLL | 7.200 |
| 1146 | LVEPHSGRL | 7.200 |
| 971 | LLPEPSAGL | 7.200 |
| 2002 | TLVLLLLVL | 7.200 |
| 851 | QGLRLLRGL | 7.200 |
| 151 | ELEPGEAQL | 7.200 |
| 881 | LAEEPQPPL | 7.200 |
| 1661 | DPEEAQALL | 7.200 |
| 430 | GLPALRLGL | 7.200 |
| 1208 | SYRESPNFT | 7.200 |
| 707 | AAVEAQPLL | 7.200 |
| 79 | TLVISLQQL | 7.200 |
| 2003 | LVLLLLVLL | 7.200 |
| 761 | CWEDHTWRL | 7.200 |
| 475 | AAPEWNEQL | 7.200 |
| 2018 | VFYTIPGQI | 7.000 |
| 398 | HCSDIEKNL | 6.720 |
| 613 | TPKAVPQHL | 6.720 |
| 134 | APIQDSEEL | 6.600 |
| 38 | GPEADIGEL | 6.600 |
| 1483 | IPQNRPIKL | 6.600 |
| 635 | AMEVEVEEL | 6.600 |
| 1033 | TLSPLWDEL | 6.336 |
| 176 | QQDDEENEL | 6.336 |
| 2019 | FYTIPGQIS | 6.000 |

TABLE XVII

158P3D2v.17, ORF: 65-6175,
Frame +2, A24-9-mers
Each peptide is a portion of SEQ ID NO: 29;
each start position is Specified, the length
Of the peptide is 10 amino acids and the end
position for each peptide is the start
position plus nine.

| Pos | Subsequence | Score |
| --- | --- | --- |
| 1998 | RYWRtLVLLL | 480.000 |
| 1762 | IYVKsWVKGL | 300.000 |
| 1694 | LYHPhSPGLL | 240.000 |
| 1530 | RYIPkQLNPI | 216.000 |
| 425 | LYRAeGLPAL | 200.000 |
| 541 | LYGSpPGAGL | 200.000 |
| 271 | FYNEyFLFEF | 198.000 |
| 1415 | IYNRsLKEEF | 198.000 |
| 1465 | IYPEsEAVLF | 180.000 |
| 1836 | DYDRiSANDF | 120.000 |
| 1844 | DFLGsLELQL | 36.000 |
| 1242 | PYLQpPLSIL | 30.000 |
| 338 | TFRMdLGIIL | 24.000 |
| 71 | VFSLrPLGTL | 20.000 |
| 1823 | EFRQpAVLVL | 20.000 |
| 1094 | PYQRpELQFF | 18.000 |
| 634 | RAMEvEVEEL | 15.840 |
| 1790 | NFNWrFVFRF | 15.000 |
| 2001 | RTLVLLLLVL | 14.400 |
| 1861 | RGPELCSVQL | 14.400 |
| 75 | RPLGtLVISL | 14.400 |
| 947 | KLELfLRLGL | 14.400 |
| 839 | KLLVhSLNLL | 14.400 |
| 1028 | RVLEqTLSPL | 14.400 |
| 131 | DFGApIQDSF | 14.000 |
| 777 | KVAErLDQGL | 13.824 |
| 1081 | RALAaPRVKL | 13.200 |
| 2013 | VELLLVEYTI | 12.600 |
| 1727 | KPRQpISYEL | 12.320 |
| 1878 | RCNLfRCRRL | 12.000 |
| 427 | RAEGLPALRL | 12.000 |
| 497 | RLQLrDDAPL | 12.000 |
| 1733 | SYELrVVIWN | 10.500 |
| 612 | QTPKaVPQHL | 10.080 |
| 2008 | LVLLtVFLLL | 10.080 |

TABLE XVII-continued

158P3D2v.17, ORF: 65-6175,
Frame +2, A24-9-mers
Each peptide is a portion of SEQ ID NO: 29;
each start position is Specified, the length
Of the peptide is 10 amino acids and the end
position for each peptide is the start
position plus nine.

| Pos | Subsequence | Score |
|---|---|---|
| 1155 | SLPPnVCPVL | 10.080 |
| 795 | KPGPgACAQL | 9.600 |
| 850 | KQGLrLLRGL | 9.600 |
| 416 | RPWArLRVRL | 9.600 |
| 175 | GQQDdEENEL | 9.504 |
| 143 | IIPNvGFQEL | 9.504 |
| 104 | LQVSpIQVEL | 9.240 |
| 939 | AAPGeVCAKL | 9.240 |
| 1800 | DYLPtEREVS | 9.000 |
| 1495 | VYVVkATNLA | 9.000 |
| 1596 | QYEVdGYNAW | 9.000 |
| 958 | KQAKaCTSEL | 8.800 |
| 429 | EGLPaLRLGL | 8.640 |
| 1418 | RSLKeEFNHF | 8.640 |
| 642 | ELLPLPENVL | 8.640 |
| 183 | ELELeLEQDL | 8.640 |
| 884 | EPQPpLPDVL | 8.640 |
| 1609 | FWPSqILAGL | 8.400 |
| 106 | VSPIqVELDL | 8.400 |
| 1311 | LAEAgISRQL | 8.400 |
| 773 | NCVRkVAERL | 8.400 |
| 635 | AMEVeVEELL | 8.400 |
| 1937 | VYILtGKVEA | 8.250 |
| 1494 | RVYVvKATNL | 8.000 |
| 1872 | RNGAgPRCNL | 8.000 |
| 1639 | KVFLtPPETL | 8.000 |
| 422 | RVRLyRAEGL | 8.000 |
| 479 | WNEQLSFVEL | 7.920 |
| 1032 | QTLSpLWDEL | 7.920 |
| 37 | CGPEaDIGEL | 7.920 |
| 831 | NALDrCRGKL | 7.920 |
| 1601 | GYNAwRDAFW | 7.500 |
| 997 | LYQArGVLAA | 7.500 |
| 1074 | GPPVfLGRAL | 7.200 |
| 1229 | TAPLfHPQDL | 7.200 |

TABLE XVII-continued

158P3D2v.17, ORF: 65-6175,
Frame +2, A24-9-mers
Each peptide is a portion of SEQ ID NO: 29;
each start position is Specified, the length
Of the peptide is 10 amino acids and the end
position for each peptide is the start
position plus nine.

| Pos | Subsequence | Score |
|---|---|---|
| 1539 | IFGEiLELSI | 7.200 |
| 1047 | LIVDgRREHL | 7.200 |
| 548 | AGLRdSLQGL | 7.200 |
| 1137 | EVEPqDLAPL | 7.200 |
| 1535 | QLNPiFGEIL | 7.200 |
| 1698 | HSPGLLQGSL | 7.200 |
| 1302 | QGQKsLDPFL | 7.200 |
| 1745 | DVVLdDENPL | 7.200 |
| 571 | LLLAvSMQVL | 7.200 |
| 1 | MALTvSVQRL | 7.200 |
| 437 | GLLGsLVRAL | 7.200 |
| 157 | AQLErRAVAL | 7.200 |
| 2002 | TLVLLLLVLL | 7.200 |
| 970 | DLLPePSAGL | 7.200 |
| 78 | GTLViSLQQL | 7.200 |
| 2006 | LLLVLLTVFL | 7.200 |
| 19 | RQVKLTFRGF | 7.200 |
| 844 | SLNLLAKQGL | 7.200 |
| 1446 | GGEEeGSGHL | 7.200 |
| 2025 | QISQvIFRPL | 6.720 |
| 51 | HYGApLAGEC | 6.600 |
| 1537 | NPIFgEILEL | 6.600 |
| 1319 | QLLKpPLKKL | 6.600 |
| 133 | GAPIqDSFEL | 6.600 |
| 1482 | GIPQnRPIKL | 6.600 |
| 1483 | IPQNrPIKLL | 6.000 |
| 1821 | EAEFrQPAVL | 6.000 |
| 2007 | LLVLLTVFLL | 6.000 |
| 1002 | GVLAaDDSGL | 6.000 |
| 1556 | LTVAvFDHDL | 6.000 |

TABLE XVIII

158P3D2v.17, ORF: 65-6175,
Frame +2, B7-9-mers
Each peptide is a portion of
SEQ ID NO: 29; each start
position is Specified, the length
of the peptide is 9 amino acids
and the end position for each peptide
is the start position plus eight.

| Pos | Subsequence | Score |
|---|---|---|
| 940 | APGEVCAKL | 240.000 |
| 134 | APIQDSFEL | 240.000 |
| 1230 | APLFHPQDL | 240.000 |
| 774 | CVRKVAERL | 200.000 |
| 1148 | EPHSGRLSL | 120.000 |
| 269 | CPFYNEYFL | 80.000 |
| 107 | SPIQVELDL | 80.000 |
| 1699 | SPGLLQGSL | 80.000 |
| 1610 | WPSQILAGL | 80.000 |
| 431 | LPALRLGLL | 80.000 |
| 613 | TPKAVPQHL | 80.000 |
| 454 | EPYVRVSFL | 80.000 |
| 1483 | IPQNRPIKL | 80.000 |
| 144 | IPNVGFQEL | 80.000 |
| 1156 | LPPNVCPVL | 80.000 |
| 1322 | KPPLKKLPL | 80.000 |
| 1405 | SPKKAVATL | 80.000 |
| 492 | LTRSLRLQL | 60.000 |
| 284 | RLRLQDLLL | 40.000 |
| 1026 | TTRVLEQTL | 40.000 |
| 549 | GLRDSLQGL | 40.000 |
| 282 | DTRLRLQDL | 40.000 |
| 1963 | KGRKQPEPL | 40.000 |
| 166 | LGRRLARSL | 40.000 |
| 632 | IPRAMEVEV | 40.000 |
| 707 | AAVEAQPLL | 36.000 |
| 475 | AAPEWNEQL | 36.000 |
| 333 | ATRIGTFRM | 30.000 |
| 363 | DPRDTRAGT | 30.000 |
| 1082 | ALAAPRVKL | 27.000 |
| 1661 | DPEEAQALL | 24.000 |
| 1862 | GPELCSVQL | 24.000 |
| 38 | GPEADIGEL | 24.000 |
| 889 | LPDVLVWML | 24.000 |
| 1097 | RPELQFFPL | 24.000 |
| 1763 | YVKSWVKGL | 20.000 |
| 1876 | GPRCNLFRC | 20.000 |
| 867 | KVALAKKLL | 20.000 |
| 2008 | LVLLTVFLL | 20.000 |
| 2003 | LVLLLLVLL | 20.000 |
| 105 | QVSPIQVEL | 20.000 |
| 1282 | DPPEEEGEM | 20.000 |
| 1746 | VVLDDENPL | 20.000 |
| 1557 | TVAVFDHDL | 20.000 |
| 1224 | VVFKDTAPL | 20.000 |
| 1313 | EAGISRQLL | 18.000 |
| 1616 | AGLCQRCGL | 18.000 |
| 1607 | DAFWPSQIL | 18.000 |
| 651 | LAPCEDFLL | 12.000 |
| 800 | ACAQLKQAL | 12.000 |
| 1841 | SANDFLGSL | 12.000 |
| 959 | QAKACTSEL | 12.000 |
| 162 | RAVALGRRL | 12.000 |
| 870 | LAKKLLAKL | 12.000 |
| 53 | GAPLAGECL | 12.000 |
| 936 | APGAAPGEV | 12.000 |
| 503 | DAPLVDAAL | 12.000 |
| 706 | GAAVEAQPL | 12.000 |
| 1116 | IAAFQLIEL | 12.000 |
| 848 | LAKQGLRLL | 12.000 |
| 2 | ALTVSVQRL | 12.000 |
| 686 | RAGRLEEQL | 12.000 |
| 444 | RALHDQRVL | 12.000 |
| 825 | RTMTRPNAL | 12.000 |
| 1718 | VPAPPPVDI | 12.000 |
| 510 | ALATHVPDL | 12.000 |
| 1048 | IVDGRREHL | 9.000 |
| 1873 | NGAGPRCNL | 9.000 |
| 1504 | APADPNGKA | 9.000 |

TABLE XVIII-continued

158P3D2v.17, ORF: 65-6175,
Frame +2, B7-9-mers
Each peptide is a portion of
SEQ ID NO: 29; each start
position is Specified, the length
of the peptide is 9 amino acids
and the end position for each peptide
is the start position plus eight.

| Pos | Subsequence | Score |
|---|---|---|
| 1186 | EVEQPQVVL | 9.000 |
| 905 | WARIPAQDV | 9.000 |
| 1308 | DPFLAEAGI | 8.000 |
| 490 | PPLTRSLRL | 8.000 |
| 676 | QPISFEISI | 8.000 |
| 670 | DPTVASQPI | 8.000 |
| 1108 | GPWAAGELI | 8.000 |
| 1245 | QPPLSILVI | 8.000 |
| 2022 | IPGQISQVI | 8.000 |
| 1075 | PPVFLGRAL | 8.000 |
| 624 | SPGAEGPEI | 8.000 |
| 1320 | LLKPPLKKL | 6.000 |
| 1471 | AVLFSEPQI | 6.000 |
| 643 | LLPLPENVL | 6.000 |
| 884 | EPQPPLPDV | 6.000 |
| 996 | HLYQARGVL | 6.000 |
| 1146 | LVEPHSGRL | 6.000 |
| 563 | QGIWFRGRL | 6.000 |
| 430 | GLPALRLGL | 6.000 |
| 72 | FSLRPLGTL | 6.000 |
| 542 | YGSPPGAGL | 6.000 |
| 971 | LLPEPSAGL | 6.000 |
| 1085 | APRVKLMED | 6.000 |
| 504 | APLVDAALA | 6.000 |
| 335 | RIGTFRMDL | 6.000 |
| 1168 | RVEVLFWGL | 6.000 |
| 739 | DGSGPYFCL | 6.000 |
| 379 | LSVRARGDL | 6.000 |
| 1943 | KVEAEFELL | 6.000 |
| 1888 | RGWWPVVKL | 6.000 |
| 886 | QPPLPDVLV | 6.000 |

TABLE XIX

158P3D2v.17, ORF: 65-6175,
Frame +2, B7-10 mers
Each peptide is a portion of
SEQ ID NO: 29; each start position
is Specified, the length of the
peptide is 10 amino acids and the
end position for each peptide is
the start position plus nine.

| Pos | Subsequence | Score |
|---|---|---|
| 1727 | KPRQpISYEL | 800.000 |
| 1856 | MVRGaRGPEL | 200.000 |
| 422 | RVRLyRAEGL | 200.000 |
| 1483 | IPQNrPIKLL | 120.000 |
| 433 | ALRLgLLGSL | 120.000 |
| 416 | RPWArLRVRL | 120.000 |
| 412 | VPAErPWARL | 120.000 |
| 905 | WARIpAQDVL | 120.000 |
| 974 | EPSAgLPSSL | 80.000 |
| 884 | EPQPpLPDVL | 80.000 |
| 75 | RPLGtLVISL | 80.000 |
| 1376 | DPGDsDGVNL | 80.000 |
| 1074 | GPPVfLGRAL | 80.000 |
| 1134 | VPSEvEPQDL | 80.000 |
| 1537 | NPIFgEILEL | 80.000 |
| 320 | SPKAfHSQTL | 80.000 |
| 489 | FPPLtRSLRL | 80.000 |
| 206 | SPLKsRARAL | 80.000 |
| 795 | KPGPgACAQL | 80.000 |
| 1175 | GLRGlGRVHL | 60.000 |
| 1633 | AVKVgSKVFL | 60.000 |
| 1163 | VLREfRVEVL | 40.000 |
| 282 | DTRLrLQDLL | 40.000 |
| 1316 | ISRQlLKPPL | 40.000 |
| 68 | CSRVfSLRPL | 40.000 |
| 634 | RAMEvEVEEL | 36.000 |
| 939 | AAPGeVCAKL | 36.000 |
| 474 | AAAPeWNEQL | 36.000 |
| 509 | AALAtHVPDL | 36.000 |
| 382 | RARGdLPPPM | 30.000 |
| 1639 | KVELtPPETL | 30.000 |
| 1081 | RALAaPRVKL | 27.000 |
| 1685 | VPEHvETRPL | 24.000 |
| 134 | APIQdSFELI | 24.000 |
| 1028 | RVLEqTLSPL | 20.000 |

TABLE XIX-continued

158P3D2v.17, ORF: 65-6175,
Frame +2, B7-10 mers
Each peptide is a portion of
SEQ ID NO: 29; each start position
is Specified, the length of the
peptide is 10 amino acids and the
end position for each peptide is
the start position plus nine.

| Pos | Subsequence | Score |
|---|---|---|
| 777 | KVAErLDQGL | 20.000 |
| 649 | NVLApCEDFL | 20.000 |
| 65 | VVNCsRVFSL | 20.000 |
| 1223 | TVVFkDTAPL | 20.000 |
| 2008 | LVLLtVFLLL | 20.000 |
| 4 | TVSVqRLTGL | 20.000 |
| 1002 | GVLAaDDSGL | 20.000 |
| 1745 | DVVLdDENPL | 20.000 |
| 1494 | RVYVvKATNL | 20.000 |
| 1170 | EVLFwGLRGL | 20.000 |
| 747 | LPLChCKPCM | 20.000 |
| 1455 | LVGKfKGSFL | 20.000 |
| 232 | GVTVlEAQKL | 20.000 |
| 943 | EVCAkLELFL | 20.000 |
| 831 | NALDrCRGKL | 18.000 |
| 90 | AGHLvLREAL | 18.000 |
| 1615 | LAGLcQRCGL | 18.000 |
| 869 | ALAKkLLAKL | 12.000 |
| 1411 | ATLKIYNRSL | 12.000 |
| 133 | GAPIqDSFEL | 12.000 |
| 799 | GACAqLKQAL | 12.000 |
| 157 | AQLErRAVAL | 12.000 |
| 591 | AQQGsTLSRL | 12.000 |
| 165 | ALGRrLARSL | 12.000 |
| 1241 | QPYLqPPLSI | 12.000 |
| 706 | GAAVeAQPLL | 12.000 |
| 1229 | TAPLfHPQDL | 12.000 |
| 54 | APLAgECLSV | 12.000 |
| 545 | PPGAgLRDSL | 12.000 |
| 548 | AGLRdSLQGL | 12.000 |
| 945 | CAKLeLFLRL | 12.000 |
| 962 | ACTSeLPPDL | 12.000 |
| 802 | AQLKqALEVL | 12.000 |
| 1 | MALTvSVQRL | 12.000 |

TABLE XIX-continued

158P3D2v.17, ORF: 65-6175,
Frame +2, B7-10 mers
Each peptide is a portion of
SEQ ID NO: 29; each start position
is Specified, the length of the
peptide is 10 amino acids and the
end position for each peptide is
the start position plus nine.

| Pos | Subsequence | Score |
|---|---|---|
| 1197 | AGQGvESEVL | 12.000 |
| 442 | LVRAlHDQRV | 10.000 |
| 568 | RGRLlLAVSM | 10.000 |
| 936 | APGAaPGEVC | 9.000 |
| 1872 | RNGAgPRCNL | 9.000 |
| 588 | PPQAqQGSTL | 8.000 |
| 1986 | NPLKtFVFFI | 8.000 |
| 1070 | HNKFgPPVFL | 6.000 |
| 429 | EGLPaLRLGL | 6.000 |
| 562 | GQGIwFRGRL | 6.000 |
| 1859 | GARGpELCSV | 6.000 |
| 1047 | LIVDgRREHL | 6.000 |
| 637 | EVEVeELLPL | 6.000 |
| 963 | CTSElPPDLL | 6.000 |
| 642 | ELLPlPENVL | 6.000 |
| 1137 | EVEPqDLAPL | 6.000 |
| 1319 | QLLKpPLKKL | 6.000 |
| 970 | DLLPePSAGL | 6.000 |
| 504 | APLVdAALAT | 6.000 |
| 988 | FSYFqLRAHL | 6.000 |
| 378 | TLSVrARGDL | 6.000 |
| 1085 | APRVkLMEDP | 6.000 |
| 880 | FLAEePQPPL | 6.000 |
| 195 | EPDVeLSGVM | 6.000 |
| 1924 | RPEDlEFTDM | 6.000 |
| 564 | GIWFrGRLLL | 6.000 |
| 427 | RAEGlPALRL | 5.400 |
| 1263 | LVGShIVPHM | 5.000 |
| 1492 | LVRVyVVKAT | 5.000 |
| 2001 | RTLVlLLLVL | 4.000 |
| 1535 | QLNPiFGEIL | 4.000 |

TABLE XX

158P3D2v.17, ORF: 65-6175, Frame +2, B3501-9-mers
Each peptide is a portion of SEQ ID NO: 29; each start position is Specified, the length of the peptide is 9 amino acids and the end position for each peptide is the start position plus eight.

| Pos | Subsequence | Score |
|---|---|---|
| 1282 | DPPEEEGEM | 120.000 |
| 1976 | RPKTSFNWF | 120.000 |
| 736 | EPMDGSGPY | 80.000 |
| 1532 | IPKQLNPIF | 60.000 |
| 1405 | SPKKAVATL | 60.000 |
| 613 | TPKAVPQHL | 60.000 |
| 652 | APCEDFLLF | 60.000 |
| 1507 | DPNGKADPY | 40.000 |
| 1322 | KPPLKKLPL | 40.000 |
| 1973 | KPSRPKTSF | 40.000 |
| 940 | APGEVCAKL | 40.000 |
| 134 | APIQDSFEL | 30.000 |
| 1156 | LPPNVCPVL | 20.000 |
| 1610 | WPSQILAGL | 20.000 |
| 454 | EPYVRVSFL | 20.000 |
| 1230 | APLFHPQDL | 20.000 |
| 1148 | EPHSGRLSL | 20.000 |
| 1986 | NPLKTFVFF | 20.000 |
| 1699 | SPGLLQGSL | 20.000 |
| 107 | SPIQVELDL | 20.000 |
| 1269 | VPHMLRFTF | 20.000 |
| 431 | LPALRLGLL | 20.000 |
| 269 | CPFYNEYFL | 20.000 |
| 144 | IPNVGFQEL | 20.000 |
| 1483 | IPQNRPIKL | 20.000 |
| 418 | WARLRVRLY | 18.000 |
| 1594 | ASQYEVDGY | 15.000 |
| 363 | DPRDTRAGT | 12.000 |
| 632 | IPRAMEVEV | 12.000 |
| 1087 | RVKLMEDPY | 12.000 |
| 624 | SPGAEGPEI | 12.000 |
| 1408 | KAVATLKIY | 12.000 |
| 1661 | DPEEAQALL | 12.000 |
| 1097 | RPELQFFPL | 12.000 |
| 267 | TSCPFYNEY | 10.000 |
| 1922 | KGRPEDLEF | 9.000 |
| 1419 | SLKEEFNHF | 9.000 |
| 444 | RALHDQRVL | 9.000 |
| 959 | QAKACTSEL | 9.000 |
| 38 | GPEADIGEL | 9.000 |
| 848 | LAKQGLRLL | 9.000 |
| 870 | LAKKLLAKL | 9.000 |
| 1466 | YPESEAVLF | 9.000 |
| 1308 | DPFLAEAGI | 8.000 |
| 1802 | LPTEREVSV | 8.000 |
| 1108 | GPWAAGELI | 8.000 |
| 1245 | QPPLSILVI | 8.000 |
| 1139 | EPQDLAPLV | 8.000 |
| 670 | DPTVASQPI | 8.000 |
| 1718 | VPAPPPVDI | 8.000 |
| 1487 | RPIKLLVRV | 8.000 |
| 676 | QPISFEISI | 8.000 |
| 1550 | LPAETELTV | 8.000 |
| 2022 | IPGQISQVI | 8.000 |
| 1207 | ASYRESPNF | 7.500 |
| 1841 | SANDFLGSL | 6.000 |
| 889 | LPDVLVWML | 6.000 |
| 1876 | GPRCNLFRC | 6.000 |
| 686 | RAGRLEEQL | 6.000 |
| 333 | ATRIGTFRM | 6.000 |
| 213 | RALAHGDPF | 6.000 |
| 1035 | SPLWDELLV | 6.000 |
| 475 | AAPEWNEQL | 6.000 |
| 320 | SPKAFHSQT | 6.000 |
| 1111 | AAGELIAAF | 6.000 |
| 284 | RLRLQDLLL | 6.000 |
| 1862 | GPELCSVQL | 6.000 |
| 1963 | KGRKQPEPL | 6.000 |
| 526 | RAAGFNPTF | 6.000 |

TABLE XX-continued

158P3D2v.17, ORF: 65-6175,
Frame +2, B3501-9-mers
Each peptide is a portion of
SEQ ID NO: 29; each start position
is Specified, the length of the
peptide is 9 amino acids and the
end position for each peptide is
the start position plus eight.

| Pos | Subsequence | Score |
|---|---|---|
| 837 | RGKLLVHSL | 6.000 |
| 448 | DQRVLVEPY | 6.000 |
| 162 | RAVALGRRL | 6.000 |
| 1083 | LAAPRVKLM | 6.000 |
| 549 | GLRDSLQGL | 6.000 |
| 707 | AAVEAQPLL | 6.000 |
| 1265 | GSHIVPHML | 5.000 |
| 1451 | GSGHLVGKF | 5.000 |
| 1783 | NSLTGEGNF | 5.000 |
| 72 | FSLRPLGTL | 5.000 |
| 200 | LSGVMFSPL | 5.000 |
| 379 | LSVRARGDL | 5.000 |
| 1034 | LSPLWDELL | 5.000 |
| 5 | VSVQRLTGL | 5.000 |
| 682 | ISIGRAGRL | 5.000 |
| 2026 | ISQVIFRPL | 5.000 |
| 1548 | ISLPAETEL | 5.000 |
| 1095 | YQRPELQFF | 4.500 |
| 706 | GAAVEAQPL | 4.500 |
| 651 | LAPCEDFLL | 4.500 |
| 1344 | IPDPEELDW | 4.500 |
| 886 | QPPLPDVLV | 4.000 |
| 1161 | CPVLREFRV | 4.000 |
| 531 | NPTFGPAWV | 4.000 |
| 884 | EPQPPLPDV | 4.000 |
| 936 | APGAAPGEV | 4.000 |
| 1059 | EPPLVIINV | 4.000 |
| 1621 | RCGLPAPEY | 4.000 |
| 109 | IQVELDLKY | 4.000 |
| 1677 | MPGFGIQLV | 4.000 |
| 118 | QPPEGATGA | 4.000 |

TABLE XXI

158P3D2v.17, ORF: 65-6175,
Frame +2, B3501-9-mers
Each peptide is a portion of
SEQ ID NO: 29; each start
position is Specified, the
length of the peptide is 10 amino
acids and the end position for each
peptide is the start position plus nine.

| Pos | Subsequence | Score |
|---|---|---|
| 1727 | KPRQpISYEL | 120.000 |
| 1234 | HPQDLPEQPY | 80.000 |
| 1487 | RPIKlLVRVY | 80.000 |
| 1924 | RPEDLEFTDM | 72.000 |
| 1134 | VPSEvEPQDL | 60.000 |
| 320 | SPKAfHSQTL | 60.000 |
| 1376 | DPGDsDGVNL | 60.000 |
| 75 | RPLGtLVISL | 40.000 |
| 412 | VPAErPWARL | 40.000 |
| 747 | LPLChCKPCM | 40.000 |
| 795 | KPGPgACAQL | 40.000 |
| 736 | EPMDgSGPYF | 40.000 |
| 416 | RPWArLRVRL | 40.000 |
| 382 | RARGdLPPPM | 36.000 |
| 1035 | SPLWdELLVF | 30.000 |
| 1802 | LPTErEVSVW | 30.000 |
| 1815 | GPFAlEEAEF | 30.000 |
| 1537 | NPIFgEILEL | 30.000 |
| 269 | CPFYnEYFLF | 30.000 |
| 1976 | RPKTsFNWFV | 24.000 |
| 974 | EPSAgLPSSL | 20.000 |
| 1093 | DPYQrPELQF | 20.000 |
| 2022 | IPGQiSQVIF | 20.000 |
| 1059 | EPPLvIINVF | 20.000 |
| 753 | KPCMhVWSCW | 20.000 |
| 884 | EPQPpLPDVL | 20.000 |
| 1483 | IPQNrPIKLL | 20.000 |
| 1074 | GPPVfLGRAL | 20.000 |
| 206 | SPLKsRARAL | 20.000 |
| 118 | QPPEgATGAW | 20.000 |
| 1847 | GSLElQLPDM | 20.000 |
| 979 | LPSSLHRDDF | 20.000 |
| 489 | FPPLtRSLRL | 20.000 |
| 634 | RAMEvEVEEL | 18.000 |
| 68 | CSRVfSLRPL | 15.000 |

TABLE XXI-continued

158P3D2v.17, ORF: 65-6175, Frame +2, B3501-9-mers
Each peptide is a portion of SEQ ID NO: 29; each start position is Specified, the length of the peptide is 10 amino acids and the end position for each peptide is the start position plus nine.

| Pos | Subsequence | Score |
|---|---|---|
| 1316 | ISRQILKPPL | 15.000 |
| 886 | QPPLpDVLVW | 15.000 |
| 981 | SSLHrDDFSY | 15.000 |
| 1418 | RSLKeEFNHF | 15.000 |
| 568 | RGRLlLAVSM | 12.000 |
| 1588 | RANCgLASQY | 12.000 |
| 195 | EPDVeLSGVM | 12.000 |
| 1826 | QPAVLVLQVW | 10.000 |
| 1685 | VPEHvETRPL | 9.000 |
| 945 | CAKLeLFLRL | 9.000 |
| 476 | APEWnEQLSF | 9.000 |
| 905 | WARIpAQDVL | 9.000 |
| 1593 | LASQyEVDGY | 9.000 |
| 1986 | NPLKtFVFFI | 8.000 |
| 1241 | QPYLqPPLSI | 8.000 |
| 134 | APIQdSFELI | 8.000 |
| 1725 | DIKPrQPISY | 6.000 |
| 263 | TQRGtSCPFY | 6.000 |
| 54 | APLAgECLSV | 6.000 |
| 1081 | RALAaPRVKL | 6.000 |
| 1730 | QPISyELRVV | 6.000 |
| 831 | NALDrCRGKL | 6.000 |
| 38 | GPEAdIGELF | 6.000 |
| 1117 | AAFQlIELDY | 6.000 |
| 1550 | LPAEtELTVA | 6.000 |
| 322 | KAFHsQTLPF | 6.000 |
| 332 | MATRiGTFRM | 6.000 |
| 422 | RVRLyRAEGL | 6.000 |
| 1297 | MPKGpQGQKS | 6.000 |
| 1163 | VLREfRVEVL | 6.000 |
| 1698 | HSPGlLQGSL | 5.000 |
| 521 | ISHPgRAAGF | 5.000 |
| 470 | VSAEaAAPEW | 5.000 |
| 740 | GSGPyFCLPL | 5.000 |

TABLE XXI-continued

158P3D2v.17, ORF: 65-6175, Frame +2, B3501-9-mers
Each peptide is a portion of SEQ ID NO: 29; each start position is Specified, the length of the peptide is 10 amino acids and the end position for each peptide is the start position plus nine.

| Pos | Subsequence | Score |
|---|---|---|
| 296 | VSGVgVTSVL | 5.000 |
| 1808 | VSVWrRSGPF | 5.000 |
| 267 | TSCPfYNEYF | 5.000 |
| 1758 | MSSDiYVKSW | 5.000 |
| 1840 | ISANdFLGSL | 5.000 |
| 1404 | VSPKkAVATL | 5.000 |
| 1732 | ISYElRVVIW | 5.000 |
| 483 | LSFVeLFPPL | 5.000 |
| 106 | VSPIqVELDL | 5.000 |
| 988 | FSYFqLRAHL | 5.000 |
| 1979 | TSFNwFVNPL | 5.000 |
| 1705 | GSLHmWIDIF | 5.000 |
| 1584 | YSHHrANCGL | 5.000 |
| 133 | GAPIqDSFEL | 4.500 |
| 651 | LAPCeDFLLF | 4.500 |
| 1206 | LASYrESPNF | 4.500 |
| 1648 | LPPGsSSPTV | 4.000 |
| 777 | KVAErLDQGL | 4.000 |
| 1507 | DPNGkADPYV | 4.000 |
| 1861 | RGPElCSVQL | 4.000 |
| 1754 | LTGEmSSDIY | 4.000 |
| 967 | LPPDlLPEPS | 4.000 |
| 908 | IPAQdVLFSV | 4.000 |
| 1028 | RVLEqTLSPL | 4.000 |
| 1973 | KPSRpKTSFN | 4.000 |
| 887 | PPLPdVLVWM | 4.000 |
| 240 | KLVGvNINPY | 4.000 |
| 1643 | TPPEtLPPGS | 4.000 |
| 398 | HCSDiEKNLL | 3.000 |
| 1110 | WAAGeLIAAF | 3.000 |
| 1365 | GQHNfDEDEM | 3.000 |

Tables XXII-XLIX

TABLE XXII

158P3D2v.1-A1-9-mers
Each peptide is a portion of SEQ ID NO: 3; each start position is specified, the length of the peptide is 9 amino acids, and the end position for each peptide is the start position plus eight.

| | | |
|---|---|---|
| 187 | 80GWWPVVK | 1755316491 |
| 188 | 0GWWPVVKL | 1441796 |
| 314 | 0VLLTVFLL | 1441795 |
| 62 | 0KGLEHDKQ | 1441794 |
| 251 | 0ELLTVEEA | 1441793 |
| 125 | 0VLVLQVWD | 1441792 |
| 313 | 00VLLTVFL | 1441792 |
| 250 | 40ELLTVEE | 262154 |
| 312 | 300VLLTVF | 65803 |
| 230 | FTDMGGNVY | 36 |
| 34 | NTEDVVLDD | 25 |
| 47 | TGEMSSDIY | 25 |
| 18 | IKPRQPISY | 21 |
| 126 | VLVLQVWDY | 20 |
| 71 | ETDVHFNSL | 19 |
| 51 | SSDIYVKSW | 18 |
| 97 | PTEREVSVW | 18 |
| 326 | YTIPGQISQ | 18 |

TABLE XXIII

158P3D2v.1-A0201-9-mers
Each peptide is a portion of SEQ ID NO: 3; each start position is specified, the length of the peptide is 9 amino acids, and the end position for each peptide is the start position plus eight.

| | | |
|---|---|---|
| 187 | 80GWWPVVK | 1755316492 |
| 188 | 0GWWPVVKL | 1441812 |
| 314 | 0VLLTVFLL | 1441812 |
| 313 | 00VLLTVFL | 1441807 |
| 251 | 0ELLTVEEA | 1441804 |
| 125 | 0VLVLQVWD | 1441801 |
| 62 | 0KGLEHDKQ | 1441794 |
| 250 | 40ELLTVEE | 262150 |
| 312 | 300VLLTVF | 65807 |
| 310 | LL300VLLT | 29 |
| 309 | LLL300VLL | 27 |
| 316 | LLTVFLLLV | 27 |
| 138 | SANDFLGSL | 25 |
| 232 | DMGGNVYIL | 24 |
| 307 | VLLLL300V | 24 |
| 308 | LLLL300VL | 24 |
| 315 | VLLTVFLLL | 24 |
| 320 | FLLLVFYTI | 24 |
| 327 | TIPGQISQV | 24 |
| 142 | FLGSLELQL | 23 |
| 238 | YILTGKVEA | 22 |
| 31 | VIWNTEDVV | 20 |
| 145 | SLELQLPDM | 20 |
| 149 | QLPDMVRGA | 20 |
| 157 | ARGPELCSV | 20 |
| 236 | NVYILTGKV | 20 |
| 248 | F240ELLTV | 20 |
| 2 | WIDIFPQDV | 19 |
| 30 | VVIWNTEDV | 19 |
| 38 | VVLDDENPL | 19 |
| 122 | A120VLVLQ | 19 |
| 239 | ILTGKVEAE | 19 |
| 283 | SFNWFVNPL | 19 |
| 287 | FVNPLKTFV | 19 |
| 290 | PLKTFVFFI | 19 |
| 311 | L300VLLTV | 19 |
| 23 | PISYELRVV | 18 |
| 118 | FRQPA120V | 18 |
| 121 | PA120VLVL | 18 |
| 302 | YWRTLVLLL | 18 |
| 335 | VIFRPLHK3 | 18 |
| 39 | VLDDENPLT | 17 |
| 96 | LPTEREVSV | 17 |
| 301 | RYWRTLVLL | 17 |
| 4 | DIFPQDVPA | 16 |

TABLE XXIII-continued

158P3D2v.1-A0201-9-mers
Each peptide is a portion of SEQ ID NO: 3; each start position is specified, the length of the peptide is 9 amino acids, and the end position for each peptide is the start position plus eight.

| | | |
|---|---|---|
| 10 | VPAPPPVDI | 16 |
| 24 | ISYELRVVI | 16 |
| 46 | LTGEMSSDI | 16 |
| 64 | GLEHDKQET | 16 |
| 140 | NDFLGSLEL | 16 |
| 305 | TLVLLLL30 | 16 |
| 27 | ELRVVIWNT | 15 |
| 32 | IWNTEDVVL | 15 |
| 94 | DYLPTEREV | 15 |
| 126 | VLVLQVWDY | 15 |
| 146 | LELQLPDMV | 15 |
| 166 | QLARNGAGP | 15 |
| 170 | NGAGPRCNL | 15 |
| 231 | TDMGGNVYI | 15 |
| 246 | AEF240ELL | 15 |
| 253 | LLTVEEAEK | 15 |
| 298 | IWRRYWRTL | 15 |
| 321 | LLLVFYTIP | 15 |

TABLE XXIV

158P3D2v.1-A0203-9-mers
Each peptide is a portion of SEQ ID NO: 3; each start position is specified, the length of the peptide is 9 amino acids, and the end position for each peptide is the start position plus eight.

| | | |
|---|---|---|
| 124 | 20VLVLQVW | 1761625411 |
| 249 | 240ELLTVE | 1761625411 |
| 123 | 120VLNLQV | 1381322579 |
| 186 | 180GWWPVV | 1381322579 |
| 62 | 0KGLEHDKQ | 1346719859 |
| 125 | 0VLVLQVWD | 1346719859 |
| 188 | 0GWWPVVKL | 1346719859 |
| 251 | 0ELLTVEEA | 1346719859 |
| 313 | 00VLLTVFL | 1346719859 |
| 314 | 0VLLTVFLL | 1346719859 |
| 312 | 300VLLTVF | 1315204197 |

TABLE XXIV-continued

158P3D2v.1-A0203-9-mers
Each peptide is a portion of SEQ ID NO: 3; each start position is specified, the length of the peptide is 9 amino acids, and the end position for each peptide is the start position plus eight.

| | | |
|---|---|---|
| 187 | 80GWWPVVK | 609485069 |
| 250 | 40ELLTVEE | 2911585 |

TABLE XXV

158P3D2v.1-A3-9-mers
Each peptide is a portion of SEQ ID NO: 3; each start position is specified, the length of the peptide is 9 amino acids, and the end position for each peptide is the start position plus eight.

| | | |
|---|---|---|
| 124 | 20VLVLQVW | 1761625417 |
| 249 | 240ELLTVE | 1761625417 |
| 186 | 180GWWPVV | 1381322589 |
| 123 | 120VLVLQV | 1381322585 |
| 125 | 0VLVLQVWD | 1346719876 |
| 314 | 0VLLTVFLL | 1346719872 |
| 313 | 00VLLTVFL | 1346719864 |
| 188 | 0GWWPVVKL | 1346719863 |
| 251 | 0ELLTVEEA | 1346719862 |
| 62 | 0KGLEHDKQ | 1346719860 |
| 312 | 300VLLTVF | 1315204206 |
| 187 | 80GWWPVVK | 609485088 |
| 250 | 40ELLTVEE | 2911590 |
| 334 | QVIFRPLHK | 31 |
| 183 | RLR180GWW | 23 |
| 253 | LLTVEEAEK | 23 |
| 55 | YVKSWV60K | 22 |
| 166 | QLARNGAGP | 22 |
| 59 | WV60KGLEH | 21 |
| 103 | SVWRRSGPF | 21 |
| 122 | A120VLVLQ | 21 |
| 268 | RKQPEPLEK | 21 |
| 318 | TVFLLLVFY | 21 |
| 147 | ELQLPDMVR | 20 |
| 273 | PLEKPSRPK | 20 |
| 161 | ELCSVQLAR | 19 |

TABLE XXV-continued

158P3D2v.1-A3-9-mers
Each peptide is a portion of SEQ ID NO: 3; each start position is specified, the length of the peptide is 9 amino acids, and the end position for each peptide is the start position plus eight.

| Start | Peptide | Score |
|---|---|---|
| 195 | KLKEAEDVE | 19 |
| 206 | AQEAQAGKK | 19 |
| 177 | NLFRCRRLR | 18 |
| 320 | FLLLVFYTI | 18 |
| 9 | DVPAPPPVD | 17 |
| 45 | PLTGEMSSD | 17 |
| 53 | DIYVKSWV6 | 17 |
| 73 | DVHFNSLTG | 17 |
| 126 | VLVLQVWDY | 17 |
| 153 | MVRGARGPE | 17 |
| 209 | AQAGKKKRK | 17 |
| 214 | KKRKQRRRK | 17 |
| 258 | EAEKRPVGK | 17 |
| 300 | RRYWRTLVL | 17 |
| 308 | LLLL300VL | 17 |
| 15 | PVDIKPRQP | 16 |
| 24 | ISYELRVVI | 16 |
| 29 | RVVIWNTED | 16 |
| 78 | SLTGEGNFN | 16 |
| 142 | FLGSLELQL | 16 |
| 193 | VVKLKEAED | 16 |
| 201 | DVEREAQEA | 16 |
| 207 | QEAQAGKKK | 16 |
| 222 | KGRPEDLEF | 16 |
| 236 | NVYILTGKV | 16 |
| 238 | YILTGKVEA | 16 |
| 239 | ILTGKVEAE | 16 |
| 261 | KRPVGKGRK | 16 |
| 263 | PVGKGRKQP | 16 |
| 294 | FVFFIWRRY | 16 |
| 309 | LLL300VLL | 16 |
| 315 | VLLTVFLLL | 16 |
| 327 | TIPGQISQV | 16 |

TABLE XXVI

158P3D2v.1-A26-9-mers
Each peptide is a portion of SEQ ID NO: 3; each start position is specified, the length of the peptide is 9 amino acids, and the end position for each peptide is the start position plus eight.

| Start | Peptide | Score |
|---|---|---|
| 187 | 80GWWPVVK | 1755316490 |
| 314 | 0VLLTVFLL | 1441814 |
| 188 | 0GWWPVVKL | 1441805 |
| 313 | 00VLLTVFL | 1441805 |
| 125 | 0VLVLQVWD | 1441803 |
| 251 | 0ELLTVEEA | 1441796 |
| 62 | 0KGLEHDKQ | 1441793 |
| 250 | 40ELLTVEE | 262145 |
| 312 | 300VLLTVF | 65815 |
| 318 | TVFLLLVFY | 30 |
| 71 | ETDVHFNSL | 27 |
| 294 | FVFFIWRRY | 26 |
| 317 | LTVFLLLVF | 26 |
| 37 | DVVLDDENP | 22 |
| 73 | DVHFNSLTG | 21 |
| 101 | EVSVWRRSG | 21 |
| 135 | DRISANDFL | 21 |
| 232 | DMGGNVYIL | 21 |
| 103 | SVWRRSGPF | 20 |
| 38 | VVLDDENPL | 19 |
| 230 | FTDMGGNVY | 19 |
| 245 | EAEF240EL | 19 |
| 9 | DVPAPPPVD | 18 |
| 68 | DKQETDVHF | 18 |
| 126 | VLVLQVWDY | 18 |
| 201 | DVEREAQEA | 18 |
| 323 | LVFYTIPGQ | 18 |
| 4 | DIFPQDVPA | 17 |
| 200 | EDVEREAQE | 17 |
| 286 | WFVNPLKTF | 17 |
| 138 | SANDFLGSL | 16 |
| 192 | PVVKLKEAE | 16 |
| 240 | LTGKVEAEF | 16 |
| 30 | VVIWNTEDV | 15 |
| 36 | EDVVLDDEN | 15 |
| 49 | EMSSDIYVK | 15 |

TABLE XXVI-continued

158P3D2v.1-A26-9-mers
Each peptide is a portion of SEQ ID NO: 3; each start position is specified, the length of the peptide is 9 amino acids, and the end position for each peptide is the start position plus eight.

| | | |
|---|---|---|
| 55 | YVKSWV60K | 15 |
| 254 | LTVEEAEKR | 15 |
| 304 | RTLVLLLL3 | 15 |
| 306 | LVLLLL300 | 15 |
| 326 | YTIPGQISQ | 15 |
| 334 | QVIFRPLHK | 15 |

TABLE XXVII

158P3D2v.1-B0702-9-mers
Each peptide is a portion of SEQ ID NO: 3; each start position is specified, the length of the peptide is 9 amino acids, and the end position for each peptide is the start position plus eight.

| | | |
|---|---|---|
| 249 | 240ELLTVE | 1761625413 |
| 124 | 20VLVLQVW | 1761625412 |
| 186 | 180GWWPVV | 1381322590 |
| 123 | 120VLVLQV | 1381322588 |
| 188 | 0GWWPVVKL | 1346719875 |
| 313 | 00VLLTVFL | 1346719873 |
| 314 | 0VLLTVFLL | 1346719870 |
| 251 | 0ELLTVEEA | 1346719866 |
| 125 | 0VLVLQVWD | 1346719861 |
| 62 | 0KGLEHDKQ | 1346719860 |
| 312 | 300VLLTVF | 1315204205 |
| 187 | 80GWWPVVK | 609485073 |
| 250 | 40ELLTVEE | 2911588 |
| 10 | VPAPPPVDI | 23 |
| 276 | KPSRPKTSF | 23 |
| 159 | GPELCSVQL | 22 |
| 289 | NPLKTFVFF | 21 |
| 120 | QPA120VLV | 19 |
| 328 | IPGQISQVI | 19 |
| 22 | QPISYELRV | 18 |
| 96 | LPTEREVSV | 18 |
| 279 | RPKTSFNWF | 18 |
| 170 | NGAGPRCNL | 17 |

TABLE XXVII-continued

158P3D2v.1-B0702-9-mers
Each peptide is a portion of SEQ ID NO: 3; each start position is specified, the length of the peptide is 9 amino acids, and the end position for each peptide is the start position plus eight.

| | | |
|---|---|---|
| 19 | KPRQPISYE | 16 |
| 191 | WPVVKLKEA | 16 |
| 266 | KGRKQPEPL | 15 |
| 300 | RRYWRTLVL | 15 |
| 302 | YWRTLVLLL | 15 |
| 32 | IWNTEDVVL | 14 |
| 119 | RQPA120VL | 14 |
| 121 | PA120VLVL | 14 |
| 154 | VRGARGPEL | 14 |
| 232 | DMGGNVYIL | 14 |
| 262 | RPVGKGRKQ | 14 |
| 12 | APPPVDIKP | 13 |
| 59 | WV60KGLEH | 13 |
| 71 | ETDVHFNSL | 13 |
| 105 | WRRSGPFAL | 13 |
| 142 | FLGSLELQL | 13 |
| 150 | LPDMVRGAR | 13 |
| 220 | RRKGRPEDL | 13 |
| 298 | IWRRYWRTL | 13 |
| 301 | RYWRTLVLL | 13 |
| 309 | LLL300VLL | 13 |
| 315 | VLLTVFLLL | 13 |
| 332 | ISQVIFRPL | 13 |
| 6 | FPQDVPAPP | 12 |
| 16 | VDIKPRQPI | 12 |
| 57 | KSWV60KGL | 12 |
| 88 | RFVFRFDYL | 12 |
| 109 | GPFALEEAE | 12 |
| 140 | NDFLGSLEL | 12 |
| 173 | GPRCNLFRC | 12 |
| 222 | KGRPEDLEF | 12 |
| 246 | AEF240ELL | 12 |
| 270 | QPEPLEKPS | 12 |
| 283 | SFNWFVNPL | 12 |
| 303 | WRTLVLLLL | 12 |

TABLE XXVIII

158P3D2v.1-B08-9-mers
Each peptide is a portion of SEQ ID NO: 3; each start position is specified, the length of the peptide is 9 amino acids, and the end position for each peptide is the start position plus eight.

| Start | Peptide | Score |
|---|---|---|
| 187 | 80GWWPVVK | 1755316491 |
| 188 | 0GWWPVVKL | 1441804 |
| 313 | 00VLLTVFL | 1441804 |
| 314 | 0VLLTVFLL | 1441804 |
| 251 | 0ELLTVEEA | 1441795 |
| 125 | 0VLVLQVWD | 1441794 |
| 62 | 0KGLEHDKQ | 1441793 |
| 250 | 40ELLTVEE | 262147 |
| 312 | 300VLLTVF | 65809 |
| 220 | RRKGRPEDL | 28 |
| 181 | CRRLR180G | 25 |
| 193 | VVKLKEAED | 23 |
| 290 | PLKTFVFFI | 23 |
| 17 | DIKPRQPIS | 22 |
| 183 | RLR180GWW | 22 |
| 279 | RPKTSFNWF | 22 |
| 211 | AGKKKRKQR | 21 |
| 154 | VRGARGPEL | 20 |
| 213 | KKKRKQRRR | 20 |
| 272 | EPLEKPSRP | 20 |
| 159 | GPELCSVQL | 19 |
| 171 | GAGPRCNLF | 19 |
| 191 | WPVVKLKEA | 19 |
| 212 | GKKKRKQRR | 19 |
| 239 | ILTGKVEAE | 19 |
| 264 | VGKRKQPE | 19 |
| 88 | RFVFRFDYL | 18 |
| 120 | QPA120VLV | 18 |
| 176 | CNLFRCRRL | 18 |
| 195 | KLKEAEDVE | 18 |
| 215 | KRKQRRRKG | 18 |
| 245 | EAEF240EL | 18 |
| 288 | VNPLKTFVF | 18 |
| 300 | RRYWRTLVL | 18 |
| 59 | WV60KGLEH | 17 |
| 96 | LPTEREVSV | 17 |
| 105 | WRRSGPFAL | 17 |
| 142 | FLGSLELQL | 17 |
| 298 | IWRRYWRTL | 17 |
| 302 | YWRTLVLLL | 17 |
| 308 | LLLL300VL | 17 |
| 309 | LLL300VLL | 17 |
| 315 | VLLTVFLLL | 17 |
| 27 | ELRVVIWNT | 16 |
| 103 | SVWRRSGPF | 16 |
| 138 | SANDFLGSL | 16 |
| 218 | QRRRKGRPE | 16 |
| 262 | RPVGKGRKQ | 16 |
| 266 | KGRKQPEPL | 16 |
| 277 | PSRPKTSFN | 16 |
| 53 | DIYVKSWV6 | 15 |
| 115 | EAEFRQPA1 | 15 |
| 121 | PA120VLVL | 15 |
| 258 | EAEKRPVGK | 15 |
| 10 | VPAPPPVDI | 14 |
| 178 | LFRCRRLR1 | 14 |
| 210 | QAGKKKRKQ | 14 |
| 217 | KQRRRKGRP | 14 |
| 257 | EEAEKRPVG | 14 |
| 320 | FLLLVFYTI | 14 |

TABLE XXIX

158P3D2v.1-B1510-9-mers
Each peptide is a portion of SEQ ID NO: 3; each start position is specified, the length of the peptide is 9 amino acids, and the end position for each peptide is the start position plus eight.

| Start | Peptide | Score |
|---|---|---|
| 249 | 240ELLTVE | 1761625414 |
| 124 | 20VLVLQVW | 1761625413 |
| 186 | 180GWWPVV | 1381322583 |
| 123 | 120VLVLQV | 1381322581 |

TABLE XXIX-continued

158P3D2v.1-B1510-9-mers
Each peptide is a portion of SEQ ID NO: 3; each start position is specified, the length of the peptide is 9 amino acids, and the end position for each peptide is the start position plus eight.

| Start | Peptide | Score |
|---|---|---|
| 188 | 0GWWPVVKL | 1346719873 |
| 313 | 00VLLTVEL | 1346719871 |
| 314 | 00VLLTVFL | 1346719870 |
| 125 | 0VLVLQVWD | 1346719862 |
| 251 | 0ELLTVEEA | 1346719861 |
| 62 | 0KGLEHDKQ | 1346719859 |
| 312 | 300VLLTVF | 1315204206 |
| 187 | 80GWWPVVK | 609485074 |
| 250 | 40ELLTVEE | 2911589 |
| 32 | IWNTEDVVL | 16 |
| 298 | IWRRYWRTL | 15 |
| 332 | ISQVIFRPL | 15 |
| 159 | GPELCSVQL | 14 |
| 170 | NGAGPRCNL | 14 |
| 176 | CNLFRCRRL | 14 |
| 245 | EAEF240EL | 14 |
| 20 | PRQPISYEL | 13 |
| 57 | KSWV60KGL | 13 |
| 105 | WRRSGPFAL | 13 |
| 119 | RQPA120VL | 13 |
| 121 | PA120VLVL | 13 |
| 232 | DMGGNVYIL | 13 |
| 66 | EHDKQETDV | 12 |
| 71 | ETDVHFNSL | 12 |
| 140 | NDFLGSLEL | 12 |
| 154 | VRGARGPEL | 12 |
| 220 | RRKGRPEDL | 12 |
| 266 | KGRKQPEPL | 12 |
| 300 | RRYWRTLVL | 12 |
| 301 | RYWRTLVLL | 12 |
| 302 | YWRTLVLLL | 12 |
| 308 | LLLL300VL | 12 |
| 309 | LLL300VLL | 12 |
| 38 | VVLDDENPL | 11 |
| 138 | SANDFLGSL | 11 |
| 283 | SFNWFVNPL | 11 |

TABLE XXIX-continued

158P3D2v.1-B1510-9-mers
Each peptide is a portion of SEQ ID NO: 3; each start position is specified, the length of the peptide is 9 amino acids, and the end position for each peptide is the start position plus eight.

| Start | Peptide | Score |
|---|---|---|
| 74 | VHFNSLTGE | 10 |
| 83 | GNFNWRFVF | 10 |
| 88 | RFVFRFDYL | 10 |
| 135 | DRISANDFL | 10 |
| 142 | FLGSLELQL | 10 |
| 246 | AEF240ELL | 10 |
| 303 | WRTLVLLLL | 10 |
| 315 | VLLTVFLLL | 10 |
| 42 | DENPLTGEM | 9 |
| 68 | DKQETDVHF | 9 |
| 81 | GEGNFNWRF | 9 |
| 85 | FNWRFVFRF | 9 |
| 171 | GAGPRCNLF | 9 |
| 222 | KGRPEDLEF | 9 |
| 276 | KPSRPKTSF | 9 |
| 289 | NPLKTFVFF | 9 |
| 24 | ISYELRVVI | 8 |
| 110 | PFALEEAEF | 8 |
| 145 | SLELQLPDM | 8 |
| 240 | LTGKVEAEF | 8 |
| 286 | WFVNPLKTF | 8 |
| 288 | VNPLKTFVF | 8 |
| 317 | LTVFLLLVF | 8 |
| 329 | PGQISQVIF | 8 |

TABLE XXX

158P3D2v.1-B2705-9-mers
Each peptide is a portion of SEQ ID NO: 3; each start position is specified, the length of the peptide is 9 amino acids, and the end position for each peptide is the start position plus eight.

| Start | Peptide | Score |
|---|---|---|
| 249 | 240ELLTVE | 1761625417 |
| 124 | 20VLVLQVW | 1761625416 |
| 186 | 180GWWPVV | 1381322587 |
| 123 | 120VLVLQV | 1381322583 |

TABLE XXX-continued

158P3D2v.1-B2705-9-mers
Each peptide is a portion of SEQ ID NO: 3; each start position is specified, the length of the peptide is 9 amino acids, and the end position for each peptide is the start position plus eight.

| | | |
|---|---|---|
| 188 | 0GWWPVVKL | 1346719874 |
| 313 | 00VLLTVFL | 1346719873 |
| 314 | 0VLLTVFLL | 1346719873 |
| 125 | 0VLVLQVWD | 1346719865 |
| 251 | 0ELLTVEEA | 1346719864 |
| 62 | 0KGLEHDKQ | 1346719863 |
| 312 | 300VLLTVF | 1315204212 |
| 187 | 80GWWPVVK | 609485081 |
| 250 | 40ELLTVEE | 2911589 |
| 300 | RRYWRTLVL | 28 |
| 261 | KRPVGKGRK | 27 |
| 220 | RRKGRPEDL | 26 |
| 20 | PRQPISYEL | 25 |
| 99 | EREVSVWRR | 25 |
| 303 | WRTLVLLLL | 24 |
| 135 | DRISANDFL | 23 |
| 105 | WRRSGPFAL | 22 |
| 154 | VRGARGPEL | 22 |
| 87 | WRFVFRFDY | 21 |
| 174 | PRCNLFRCR | 21 |
| 219 | RRRKGRPED | 20 |
| 140 | NDFLGSLEL | 19 |
| 185 | R180GWWPV | 19 |
| 92 | RFDYLPTER | 18 |
| 106 | RRSGPFALE | 18 |
| 119 | RQPA120VL | 18 |
| 182 | RRLR180GW | 18 |
| 235 | GNVYILTGK | 18 |
| 268 | RKQPEPLEK | 18 |
| 81 | GEGNFNWRF | 17 |
| 83 | GNFNWRFVF | 17 |
| 159 | GPELCSVQL | 17 |
| 175 | RCNLFRCRR | 17 |
| 209 | AQAGKKKRK | 17 |
| 213 | KKKRKQRRR | 17 |
| 222 | KGRPEDLEF | 17 |

TABLE XXX-continued

158P3D2v.1-B2705-9-mers
Each peptide is a portion of SEQ ID NO: 3; each start position is specified, the length of the peptide is 9 amino acids, and the end position for each peptide is the start position plus eight.

| | | |
|---|---|---|
| 267 | GRKQPEPLE | 17 |
| 276 | KPSRPKTSF | 17 |
| 293 | TFVFFIWRR | 17 |
| 330 | GQISQVIFR | 17 |
| 77 | NSLTGEGNF | 16 |
| 91 | FRFDYLPTE | 16 |
| 168 | ARNGAGPRC | 16 |
| 189 | FWWPVVKLK | 16 |
| 214 | KKRKQRRRK | 16 |
| 215 | KRKQRRRKG | 16 |
| 246 | AEF240ELL | 16 |
| 254 | LTVEEAEKR | 16 |
| 279 | RPKTSFNWF | 16 |
| 292 | KTFVFFIWR | 16 |
| 301 | RYWRTLVLL | 16 |
| 21 | RQPISYELR | 15 |
| 32 | IWNTEDVVL | 15 |
| 49 | EMSSDIYVK | 15 |
| 88 | RFVFRFDYL | 15 |
| 111 | FALEEAEFR | 15 |
| 121 | PA120VLVL | 15 |
| 147 | ELQLPDMVR | 15 |
| 157 | ARGPELCSV | 15 |
| 170 | NGAGPRCNL | 15 |
| 171 | GAGPRCNLF | 15 |
| 208 | EAQAGKKKR | 15 |
| 211 | AGKKKRKQR | 15 |
| 223 | GRPEDLEFT | 15 |
| 240 | LTGKVEAEF | 15 |
| 271 | PEPLEKPSR | 15 |
| 278 | SRPKTSFNW | 15 |
| 289 | NPLKTFVFF | 15 |
| 317 | LTVFLLLVF | 15 |
| 318 | TVFLLLVFY | 15 |
| 337 | FRPLHK328 | 15 |

TABLE XXX-continued

158P3D2v.1-B2705-9-mers
Each peptide is a portion of SEQ ID NO: 3; each start position is specified, the length of the peptide is 9 amino acids, and the end position for each peptide is the start position plus eight.

| | | |
|---|---|---|
| 28 | LRVVIWNTE | 14 |
| 98 | TEREVSVWR | 14 |
| 110 | PFALEEAEF | 14 |
| 161 | ELCSVQLAR | 14 |
| 176 | CNLFRCRRL | 14 |
| 196 | LKEAEDVER | 14 |
| 205 | EAQEAQAGK | 14 |
| 206 | AQEAQAGKK | 14 |
| 207 | QEAQAGKKK | 14 |
| 216 | RKQRRRKGR | 14 |
| 232 | DMGGNVYIL | 14 |
| 266 | KGRKQPEPL | 14 |
| 273 | PLEKPSRPK | 14 |
| 286 | WFVNPLKTF | 14 |
| 294 | FVFFIWRRY | 14 |
| 308 | LLLL300VL | 14 |
| 315 | VLLTVFLLL | 14 |
| 329 | PGQISQVIF | 14 |

TABLE XXXI

158P3D2v.1-B2709-9-mers
Each peptide is a portion of SEQ ID NO: 3; each start position is specified, the length of the peptide is 9 amino acids, and the end position for each peptide is the start position plus eight.

| | | |
|---|---|---|
| 187 | 80GWWPVVK | 1755316491 |
| 314 | 0VLLTVFLL | 1441805 |
| 188 | 0GWWPVVKL | 1441804 |
| 313 | 00VLLTVEL | 1441804 |
| 125 | 0VLVLQVWD | 1441795 |
| 251 | 0ELLTVEEA | 1441795 |
| 62 | 0KGLEHDKQ | 1441792 |
| 250 | 40ELLTVEE | 262145 |
| 312 | 300VLLTVF | 65810 |
| 300 | RRYWRTLVL | 27 |
| 185 | R180GWWPV | 24 |

TABLE XXXI-continued

158P3D2v.1-B2709-9-mers
Each peptide is a portion of SEQ ID NO: 3; each start position is specified, the length of the peptide is 9 amino acids, and the end position for each peptide is the start position plus eight.

| | | |
|---|---|---|
| 220 | RRKGRPEDL | 24 |
| 20 | PRQPISYEL | 23 |
| 135 | DRISANDFL | 22 |
| 303 | WRTLVLLLL | 22 |
| 105 | WRRSGPFAL | 21 |
| 154 | VRGARGPEL | 21 |
| 157 | ARGPELCSV | 20 |
| 118 | FRQPA120V | 19 |
| 299 | WRRYWRTLV | 18 |
| 182 | RRLR180GW | 16 |
| 88 | RFVFRFDYL | 15 |
| 159 | GPELCSVQL | 15 |
| 219 | RRRKGRPED | 15 |
| 246 | AEF240ELL | 15 |
| 301 | RYWRTLVLL | 15 |
| 106 | RRSGPFALE | 14 |
| 119 | RQPA120VL | 14 |
| 121 | PA120VLVL | 14 |
| 223 | GRPEDLEFT | 14 |
| 267 | GRKQPEPLE | 14 |

TABLE XXX-II

158P3DWv.1-B4402-9-mers
Each peptide is a portion of SEQ ID NO: 3; each start position is specified, the length of the peptide is 9 amino acids, and the end position for each peptide is the start position plus eight.

| | | |
|---|---|---|
| 124 | 20VLVLQVW | 1761625424 |
| 249 | 240ELLTVE | 1761625414 |
| 123 | 120VLVLQV | 1381322582 |
| 186 | 180GWWPVV | 1381322581 |
| 314 | 0VLLTVFLL | 1346719873 |
| 188 | 0GWWPVVKL | 1346719872 |
| 251 | 0ELLTVEEA | 1346719872 |
| 313 | 00VLLTVFL | 1346719872 |

TABLE XXX-II-continued

158P3DWv.1-B4402-9-mers
Each peptide is a portion of SEQ ID NO: 3; each start position is specified, the length of the peptide is 9 amino acids, and the end position for each peptide is the start position plus eight.

| | | |
|---|---|---|
| 62 | 0KGLEHDKQ | 1346719861 |
| 125 | 0VLVLQVWD | 1346719861 |
| 312 | 300VLLTVF | 1315204209 |
| 187 | 80GWWPVVK | 609485072 |
| 250 | 40ELLTVEE | 2911588 |
| 246 | AEF240ELL | 28 |
| 81 | GEGNFNWRF | 21 |
| 116 | AEFRQPA12 | 20 |
| 199 | AEDVEREAQ | 17 |
| 57 | KSWV60KGL | 16 |
| 171 | GAGPRCNLF | 16 |
| 259 | AEKRPVGKG | 16 |
| 25 | SYELRVVIW | 15 |
| 51 | SSDIYVKSW | 15 |
| 71 | ETDVHFNSL | 15 |
| 83 | GNFNWRFVF | 15 |
| 140 | NDFLGSLEL | 15 |
| 222 | KGRPEDLEF | 15 |
| 274 | LEKPSRPKT | 15 |
| 286 | WFVNPLKTF | 15 |
| 315 | VLLTVFLLL | 15 |
| 318 | TVFLLLVFY | 15 |
| 18 | IKPRQPISY | 14 |
| 20 | PRQPISYEL | 14 |
| 26 | YELRVVIWN | 14 |
| 42 | DENPLTGEM | 14 |
| 121 | PA120VLVL | 14 |
| 245 | EAEF240EL | 14 |
| 257 | EEAEKRPVG | 14 |
| 288 | VNPLKTFVF | 14 |
| 289 | NPLKTFVFF | 14 |
| 294 | FVFFIWRRY | 14 |
| 295 | VFFIWRRYW | 14 |
| 300 | RRYWRTLVL | 14 |
| 301 | RYWRTLVLL | 14 |
| 302 | YWRTLVLLL | 14 |
| 303 | WRTLVLLLL | 14 |
| 309 | LLL300VLL | 14 |

TABLE XXXIII

158P3D2v.1-B5101-9-mers
Each peptide is a portion of SEQ ID NO: 3; each start position is specified, the length of the peptide is 9 amino acids, and the end position for each peptide is the start position plus eight.

| | | |
|---|---|---|
| 187 | 80GWWPVVK | 1755316495 |
| 188 | 0GWWPVVKL | 1441810 |
| 314 | 0VLLTVFLL | 1441803 |
| 313 | 00VLLTVFL | 1441799 |
| 251 | 0ELLTVEEA | 1441797 |
| 125 | 0VLVLQVWD | 1441795 |
| 62 | 0KGLEHDKQ | 1441794 |
| 250 | 40ELLTVEE | 262145 |
| 312 | 300VLLTVF | 65807 |
| 328 | IPGQISQVI | 25 |
| 121 | PA120VLVL | 24 |
| 10 | VPAPPPVDI | 23 |
| 96 | LPTEREVSV | 23 |
| 24 | ISYELRVVI | 22 |
| 22 | QPISYELRV | 21 |
| 120 | QPA120VLV | 19 |
| 138 | SANDFLGSL | 18 |
| 320 | FLLLVFYTI | 18 |
| 159 | GPELCSVQL | 17 |
| 272 | EPLEKPSRP | 17 |
| 289 | NPLKTFVFF | 17 |
| 311 | L300VLLTV | 17 |
| 324 | VFYTIPGQI | 17 |
| 12 | APPPVDIKP | 16 |
| 94 | DYLPTEREV | 16 |
| 111 | FALEEAEFR | 16 |

TABLE XXXIII-continued

158P3D2v.1-B5101-9-mers
Each peptide is a portion of SEQ ID NO: 3; each start position is specified, the length of the peptide is 9 amino acids, and the end position for each peptide is the start position plus eight.

| 245 | EAEF240EL | 16 |
|---|---|---|
| 6 | FPQDVPAPP | 15 |
| 46 | LTGEMSSDI | 15 |
| 82 | EGNFNWRFV | 15 |
| 210 | QAGKKKRKQ | 15 |
| 236 | NVYILTGKV | 15 |
| 248 | F240ELLTV | 15 |
| 262 | RPVGKGRKQ | 15 |
| 31 | VIWNTEDVV | 14 |
| 44 | NPLTGEMSS | 14 |
| 150 | LPDMVRGAR | 14 |
| 170 | NGAGPRCNL | 14 |
| 198 | EAEDVEREA | 14 |
| 208 | EAQAGKKKR | 14 |
| 231 | TDMGGNVYI | 14 |
| 266 | KGRKQPEPL | 14 |
| 279 | RPKTSFNWF | 14 |
| 300 | RRYWRTLVL | 14 |
| 315 | VLLTVFLLL | 14 |
| 11 | PAPPPVDIK | 13 |
| 13 | PPPVDIKPR | 13 |
| 23 | PISYELRVV | 13 |
| 32 | IWNTEDVVL | 13 |
| 129 | LQVWDYDRI | 13 |
| 146 | LELQLPDMV | 13 |
| 167 | LARNGAGPR | 13 |
| 191 | WPVVKLKEA | 13 |
| 194 | VKLKEAEDV | 13 |
| 224 | RPEDLEFTD | 13 |
| 232 | DMGGNVYIL | 13 |
| 258 | EAEKRPVGK | 13 |
| 290 | PLKTFVFFI | 13 |
| 308 | LLLL300VL | 13 |

TABLE XXXIV

158P3D2v.1-A1-10-mers
Each peptide is a portion of SEQ ID NO: 3; each start position is specified, the length of the peptide is 10 amino acids, and the end position for each peptide is the start position plus nine.

| 124 | 20VLVLQVWD | 1761625411 |
|---|---|---|
| 249 | 240ELLTVEE | 1761625411 |
| 186 | 180GWWPVVK | 1381322581 |
| 123 | 120VLVLQVW | 1381322580 |
| 125 | 0VLVLQVWDY | 1346719875 |
| 314 | 0VLLTVFLLL | 1346719870 |
| 188 | 0GWWPVVKLK | 1346719862 |
| 313 | 00VLLTVFLL | 1346719862 |
| 62 | 0KGLEHDKQE | 1346719859 |
| 251 | 0ELLTVEEAE | 1346719859 |
| 312 | 300VLLTVFL | 1315204197 |
| 187 | 80GWWPVVKL | 609485072 |
| 250 | 40ELLTVEEA | 2911596 |
| 17 | DIKPRQPISY | 23 |
| 46 | LTGEMSSDIY | 21 |
| 317 | LTVFLLLVFY | 21 |
| 71 | ETDVHFNSLT | 19 |
| 39 | VLDDENPLTG | 18 |
| 230 | FTDMGGNVYI | 18 |
| 25 | SYELRVVIWN | 17 |
| 139 | ANDFLGSLEL | 17 |
| 229 | EFTDMGGNVY | 17 |
| 34 | NTEDVVLDDE | 16 |
| 51 | SSDIYVKSWV | 16 |
| 86 | NWRFVFRFDY | 16 |
| 97 | PTEREVSVWR | 16 |
| 112 | ALEEAEFRQP | 15 |
| 293 | TFVFFIWRRY | 15 |
| 47 | TGEMSSDIYV | 14 |
| 145 | SLELQLPDMV | 14 |
| 206 | AQEAQAGKKK | 14 |
| 270 | QPEPLEKPSR | 14 |
| 273 | PLEKPSRPKT | 14 |
| 159 | GPELCSVQLA | 13 |
| 224 | RPEDLEFTDM | 13 |
| 256 | VEEAEKRPVG | 13 |

TABLE XXXIV-continued

158P3D2v.1-A1-10-mers
Each peptide is a portion of SEQ ID NO: 3; each start position is specified, the length of the peptide is 10 amino acids, and the end position for each peptide is the start position plus nine.

| | | |
|---|---|---|
| 258 | EAEKRPVGKG | 13 |
| 80 | TGEGNFNWRF | 12 |
| 115 | EAEFRQPA12 | 12 |
| 189 | GWWPVVKLKE | 12 |
| 245 | EAEF240ELL | 12 |
| 304 | RTLVLLLL30 | 12 |
| 326 | YTIPGQISQV | 12 |

TABLE XXXV

158P3D2v.1-A0201-10-mers
Each peptide is a portion of SEQ ID NO: 3; each start position is specified, the length of the peptide is 10 amino acids, and the end position for each peptide is the start position plus nine.

| | | |
|---|---|---|
| 187 | 80GWWPVVKL | 1755316508 |
| 314 | 0VLLTVFLLL | 1441809 |
| 313 | 00VLLTVFLL | 1441806 |
| 125 | 0VLVLQVWDY | 1441802 |
| 188 | 0GWWPVVKLK | 1441796 |
| 251 | 0ELLTVEEAE | 1441795 |
| 62 | 0KGLEHDKQE | 1441791 |
| 250 | 40ELLTVEEA | 262153 |
| 312 | 300VLLTVFL | 65814 |
| 310 | LL300VLLTV | 37 |
| 122 | A120VLVLQV | 28 |
| 315 | VLLTVFLLLV | 28 |
| 95 | YLPTEREVSV | 26 |
| 308 | LLLL300VLL | 26 |
| 247 | EF240ELLTV | 25 |
| 309 | LLL300VLLT | 24 |
| 326 | YTIPGQISQV | 24 |
| 156 | GARGPELCSV | 23 |
| 307 | VLLLL300VL | 23 |
| 31 | VIWNTEDVVL | 22 |
| 297 | FIWRRYWRTL | 22 |

TABLE XXXV-continued

158P3D2v.1-A0201-10-mers
Each peptide is a portion of SEQ ID NO: 3; each start position is specified, the length of the peptide is 10 amino acids, and the end position for each peptide is the start position plus nine.

| | | |
|---|---|---|
| 145 | SLELQLPDMV | 21 |
| 137 | ISANDFLGSL | 20 |
| 128 | VLQVWDYDRI | 19 |
| 153 | MVRGARGPEL | 19 |
| 231 | TDMGGNVYIL | 18 |
| 306 | LVLLLL300V | 18 |
| 327 | TIPGQISQVI | 18 |
| 331 | QISQVIFRPL | 18 |

TABLE XXXVI

158P3D2v.1-A0203-10-mers
Each peptide is a portion of SEQ ID NO: 3; each start position is specified, the length of the peptide is 10 amino acids, and the end position for each peptide is the start position plus nine.

| | | |
|---|---|---|
| 124 | 20VLVLQVWD | 1761625411 |
| 249 | 240ELLTVEE | 1761625411 |
| 123 | 120VLVLQVW | 1381322579 |
| 186 | 180GWWPVVK | 1381322579 |
| 251 | 0ELLTVEEAE | 1346719868 |
| 62 | 0KGLEHDKQE | 1346719859 |
| 125 | 0VLVLQVWDY | 1346719859 |
| 188 | 0GWWPVVKLK | 1346719859 |
| 313 | 00VLLTVFLL | 1346719859 |
| 314 | 0VLLTVFLLL | 1346719859 |
| 312 | 300VLLTVFL | 1315204197 |
| 187 | 80GWWPVVKL | 609485069 |
| 250 | 40ELLTVEEA | 2911595 |
| 202 | VEREAQEAQA | 18 |
| 3 | IDIFPQDVPA | 10 |
| 103 | SVWRRSGPFA | 10 |
| 107 | RSGPFALEEA | 10 |
| 113 | LEEAEFRQPA | 10 |
| 130 | QVWDYDRISA | 10 |
| 148 | LQLPDMVRGA | 10 |
| 159 | GPELCSVQLA | 10 |

TABLE XXXVI-continued

158P3D2v.1-A0203-10-mers
Each peptide is a portion of SEQ ID NO: 3; each start position is specified, the length of the peptide is 10 amino acids, and the end position for each peptide is the start position plus nine.

| | | |
|---|---|---|
| 163 | CSVQLARNGA | 10 |
| 190 | WWPVVKLKEA | 10 |
| 197 | KEAEDVEREA | 10 |
| 200 | EDVEREAQEA | 10 |
| 237 | VYILTGKVEA | 10 |
| 4 | DIFPQDVPAP | 9 |
| 104 | VWRRSGPFAL | 9 |
| 108 | SGPFALEEAE | 9 |
| 114 | EEAEFRQPA1 | 9 |
| 131 | VWDYDRISAN | 9 |
| 149 | QLPDMVRGAR | 9 |
| 160 | PELCSVQLAR | 9 |
| 164 | SVQLARNGAG | 9 |
| 191 | WPVVKLKEAE | 9 |
| 198 | EAEDVEREAQ | 9 |
| 201 | DVEREAQEAQ | 9 |
| 203 | EREAQEAQAG | 9 |
| 238 | YILTGKVEAE | 9 |

TABLE XXXVII

158P3D2v.1-A3-10-mers
Each peptide is a portion of SEQ ID NO: 3; each start position is specified, the length of the peptide is 10 amino acids, and the end position for each peptide is the start position plus nine.

| | | |
|---|---|---|
| 124 | 20VLVLQVWD | 1761625417 |
| 249 | 240ELLTVEE | 1761625416 |
| 186 | 180GWWPVVK | 1381322604 |
| 123 | 120VLVLQVW | 1381322583 |
| 125 | 0VLVLQVWDY | 1346719877 |
| 314 | 0VLLTVFLLL | 1346719875 |
| 188 | 0GWWPVVKLK | 1346719869 |
| 62 | 0KGLEHDKQE | 1346719863 |
| 251 | 0ELLTVEEAE | 1346719863 |
| 313 | 00VLLTVFLL | 1346719860 |
| 312 | 300VLLTVFL | 1315204201 |
| 187 | 80GWWPVVKL | 609485073 |
| 250 | 40ELLTVEEA | 2911586 |
| 183 | RLR180GWWP | 25 |
| 252 | ELLTVEEAEK | 25 |
| 166 | QLARNGAGPR | 24 |
| 195 | KLKEAEDVER | 23 |
| 122 | A120VLVLQV | 22 |
| 236 | NVYILTGKVE | 22 |
| 17 | DIKPRQPISY | 21 |
| 239 | ILTGKVEAEF | 21 |
| 287 | FVNPLKTFVF | 21 |
| 316 | LLTVFLLLVF | 21 |
| 149 | QLPDMVRGAR | 20 |
| 39 | VLDDENPLTG | 19 |
| 153 | MVRGARGPEL | 18 |
| 204 | REAQEAQAGK | 18 |
| 206 | AQEAQAGKKK | 18 |
| 213 | KKKRKQRRRK | 18 |
| 9 | DVPAPPPVDI | 17 |
| 23 | PISYELRVVI | 17 |
| 27 | ELRVVIWNTE | 17 |
| 30 | VVIWNTEDVV | 17 |
| 31 | VIWNTEDVVL | 17 |
| 103 | SVWRRSGPFA | 17 |
| 112 | ALEEAEFRQP | 17 |
| 136 | RISANDFLGS | 17 |
| 177 | NLFRCRRLR1 | 17 |
| 247 | EF240ELLTV | 17 |
| 253 | LLTVEEAEKR | 17 |
| 257 | EEAEKRPVGK | 17 |
| 260 | EKRPVGKGRK | 17 |
| 307 | VLLLL300VL | 17 |
| 308 | LLLL300VLL | 17 |
| 310 | LL300VLLTV | 17 |
| 53 | DIYVKSWV60 | 16 |

TABLE XXXVII-continued

158P3D2v.1-A3-10-mers
Each peptide is a portion of SEQ ID NO: 3; each start position is specified, the length of the peptide is 10 amino acids, and the end position for each peptide is the start position plus nine.

| | | |
|---|---|---|
| 89 | FVFRFDYLPT | 16 |
| 95 | YLPTEREVSV | 16 |
| 127 | LVLQVWDYDR | 16 |
| 130 | QVWDYDRISA | 16 |
| 333 | SQVIFRPLHK | 16 |
| 334 | QVIFRPLHK3 | 16 |
| 29 | RVVIWNTEDV | 15 |
| 45 | PLTGEMSSDI | 15 |
| 147 | ELQLPDMVRG | 15 |
| 193 | VVKLKEAEDV | 15 |
| 205 | EAQEAQAGKK | 15 |
| 243 | KVEAEF240E | 15 |
| 267 | GRKQPEPLEK | 15 |
| 297 | FIWRRYWRTL | 15 |
| 309 | LLL300VLLT | 15 |
| 315 | VLLTVFLLLV | 15 |
| 323 | LVFYTIPGQI | 15 |
| 10 | VPAPPPVDIK | 14 |
| 48 | GEMSSDIYVK | 14 |
| 64 | GLEHDKQETD | 14 |
| 101 | EVSVWRRSGP | 14 |
| 145 | SLELQLPDMV | 14 |
| 164 | SVQLARNGAG | 14 |
| 201 | DVEREAQEAQ | 14 |
| 221 | RKGRPEDLEF | 14 |
| 229 | EFTDMGGNVY | 14 |
| 259 | AEKRPVGKGR | 14 |
| 320 | FLLLVFYTIP | 14 |
| 327 | TIPGQISQVI | 14 |
| 2 | WIDIFPQDVP | 13 |
| 38 | VVLDDENPLT | 13 |
| 54 | IYVKSWV60K | 13 |
| 78 | SLTGEGNFNW | 13 |
| 157 | ARGPELCSVQ | 13 |
| 161 | ELCSVQLARN | 13 |
| 192 | PVVKLKEAED | 13 |
| 272 | EPLEKPSRPK | 13 |
| 306 | LVLLLL300V | 13 |

TABLE XXXVIII

158P3D2v.1-A26-10-mers
Each peptide is a portion of SEQ ID NO: 3; each start position is specified, the length of the peptide is 10 amino acids, and the end position for each peptide is the start position plus nine.

| | | |
|---|---|---|
| 187 | 80GWWPVVKL | 1755316503 |
| 125 | 0VLVLQVWDY | 1441816 |
| 314 | 0VLLTVFLLL | 1441811 |
| 313 | 00VLLTVFLL | 1441808 |
| 188 | 0GWWPVVKLK | 1441796 |
| 62 | 0KGLEHDKQE | 1441793 |
| 251 | 0ELLTVEEAE | 1441793 |
| 250 | 40ELLTVEEA | 262148 |
| 312 | 300VLLTVFL | 65810 |
| 37 | DVVLDDENPL | 30 |
| 317 | LTVFLLLVFY | 26 |
| 17 | DIKPRQPISY | 25 |
| 229 | EFTDMGGNVY | 23 |
| 4 | DIFPQDVPAP | 22 |
| 73 | DVHFNSLTGE | 22 |
| 101 | EVSVWRRSGP | 21 |
| 46 | LTGEMSSDIY | 20 |
| 275 | EKPSRPKTSF | 20 |
| 334 | QVIFRPLHK3 | 20 |
| 71 | ETDVHFNSLT | 19 |
| 153 | MVRGARGPEL | 19 |
| 201 | DVEREAQEAQ | 19 |
| 287 | FVNPLKTFVF | 19 |
| 318 | TVFLLLVFYT | 19 |
| 326 | YTIPGQISQV | 19 |
| 9 | DVPAPPPVDI | 18 |
| 82 | EGNFNWRFVF | 18 |

TABLE XXXVIII-continued

158P3D2v.1-A26-10-mers
Each peptide is a portion of SEQ ID NO: 3;
each start position is specified, the
length of the peptide is 10 amino acids,
and the end position for each peptide is
the start position plus nine.

| 141 | DFLGSLELQL | 18 |
|---|---|---|
| 245 | EAEF240ELL | 18 |
| 282 | TSFNWFVNPL | 17 |
| 285 | NWFVNPLKTF | 17 |
| 133 | DYDRISANDF | 16 |
| 200 | EDVEREAQEA | 16 |
| 247 | EF240ELLTV | 16 |
| 258 | EAEKRPVGKG | 16 |
| 292 | KTFVFFIWRR | 16 |
| 323 | LVFYTIPGQI | 16 |
| 89 | FVFRFDYLPT | 15 |
| 161 | ELCSVQLARN | 15 |
| 293 | TFVFFIWRRY | 15 |

TABLE XXXIX

158P3D2v.1-B0702-10-mers
Each peptide is a portion of SEQ ID NO: 3;
each start position is specified, the
length of the peptide is 10 amino acids,
and the end position for each peptide is
the start position plus nine.

| 249 | 240ELLTVEE | 1761625414 |
|---|---|---|
| 124 | 20VLVLQVWD | 1761625413 |
| 186 | 180GWWPVVK | 1381322585 |
| 123 | 120VLVLQVW | 1381322580 |
| 314 | 0VLLTVFLLL | 1346719872 |
| 313 | 00VLLTVFLL | 1346719870 |
| 62 | 0KGLEHDKQE | 1346719860 |
| 125 | 0VLVLQVWDY | 1346719860 |
| 188 | 0GWWPVVKLK | 1346719860 |
| 251 | 0ELLTVEEAE | 1346719860 |
| 312 | 300VLLTVFL | 1315204211 |
| 187 | 80GWWPVVKL | 609485083 |
| 250 | 40ELLTVEEA | 2911592 |
| 120 | QPA120VLVL | 25 |
| 19 | KPRQPISYEL | 23 |
| 328 | IPGQISQVIF | 20 |
| 224 | RPEDLEFTDM | 19 |

TABLE XXXIX-continued

158P3D2v.1-B0702-10-mers
Each peptide is a portion of SEQ ID NO: 3;
each start position is specified, the
length of the peptide is 10 amino acids,
and the end position for each peptide is
the start position plus nine.

| 289 | NPLKTFVFFI | 19 |
|---|---|---|
| 109 | GPFALEEAEF | 18 |
| 279 | RPKTSFNWFV | 18 |
| 22 | QPISYELRVV | 17 |
| 159 | GPELCSVQLA | 17 |
| 299 | WRRYWRTLVL | 16 |
| 139 | ANDFLGSLEL | 15 |
| 153 | MVRGARGPEL | 15 |
| 276 | KPSRPKTSFN | 15 |
| 12 | APPPVDIKPR | 14 |
| 141 | DFLGSLELQL | 14 |
| 169 | RNGAGPRCNL | 14 |
| 219 | RRRKGRPEDL | 14 |
| 231 | TDMGGNVYIL | 14 |
| 262 | RPVGKGRKQP | 14 |
| 301 | RYWRTLVLLL | 14 |
| 302 | YWRTLVLLLL | 14 |
| 331 | QISQVIFRPL | 14 |
| 10 | VPAPPPVDIK | 13 |
| 31 | VIWNTEDVVL | 13 |
| 104 | VWRRSGPFAL | 13 |
| 134 | YDRISANDFL | 13 |
| 158 | RGPELCSVQL | 13 |
| 173 | GPRCNLFRCR | 13 |
| 300 | RRYWRTLVLL | 13 |

TABLE XL

158P3D2v.1-B08-10-mers

No Results Found.

TABLE XLI

158P3D2v.1-B1510-10-mers

No Results Found.

TABLE XLII

158P3D2v.1-B2705-10-mers

No Results Found.

TABLE XLIII

158P3D2v.1-B2709-10-mers

No Results Found.

TABLE XLIV

158P3D2v.1-B4402-10-mers
Each peptide is a portion of SEQ ID NO: 3; each start position is specified, the length of the peptide is 10 amino acids, and the end position for each peptide is the start position plus nine.

| | | |
|---|---|---|
| 187 | 80GWWPVVKL | 1755316503 |
| 314 | 0VLLTVFLLL | 1441807 |
| 251 | 0ELLTVEEAE | 1441806 |
| 313 | 00VLLTVFLL | 1441805 |
| 125 | 0VLVLQVWDY | 1441804 |
| 62 | 0KGLEHDKQE | 1441796 |
| 188 | 0GWWPVVKLK | 1441796 |
| 250 | 40ELLTVEEA | 262146 |
| 312 | 300VLLTVFL | 65814 |
| 70 | QETDVHFNSL | 23 |
| 244 | VEAEF240EL | 20 |
| 246 | AEF240ELLT | 19 |
| 116 | AEFRQPA120 | 18 |
| 274 | LEKPSRPKTS | 17 |
| 285 | NWFVNPLKTF | 17 |
| 259 | AEKRPVGKGR | 16 |
| 17 | DIKPRQPISY | 15 |
| 26 | YELRVVIWNT | 15 |
| 48 | GEMSSDIYVK | 15 |
| 50 | MSSDIYVKSW | 15 |
| 114 | EEAEFRQPA1 | 15 |
| 139 | ANDFLGSLEL | 15 |
| 199 | AEDVEREAQE | 15 |
| 229 | EFTDMGGNVY | 15 |
| 282 | TSFNWFVNPL | 15 |
| 287 | FVNPLKTFVF | 15 |
| 82 | EGNFNWRFVF | 14 |

TABLE XLIV-continued

158P3D2v.1-B4402-10-mers
Each peptide is a portion of SEQ ID NO: 3; each start position is specified, the length of the peptide is 10 amino acids, and the end position for each peptide is the start position plus nine.

| | | |
|---|---|---|
| 104 | VWRRSGPFAL | 14 |
| 118 | FRQPA120VL | 14 |
| 120 | QPA120VLVL | 14 |
| 133 | DYDRISANDF | 14 |
| 141 | DFLGSLELQL | 14 |
| 160 | PELCSVQLAR | 14 |
| 170 | NGAGPRCNLF | 14 |
| 245 | EAEF240ELL | 14 |
| 257 | EEAEKRPVGK | 14 |
| 278 | SRPKTSFNWF | 14 |
| 288 | VNPLKTFVFF | 14 |
| 294 | FVFFIWRRYW | 14 |
| 301 | RYWRTLVLLL | 14 |
| 302 | YWRTLVLLLL | 14 |
| 308 | LLLL300VLL | 14 |
| 31 | VIWNTEDVVL | 13 |
| 42 | DENPLTGEMS | 13 |
| 56 | VKSWV60KGL | 13 |
| 87 | WRFVFRFDYL | 13 |
| 158 | RGPELCSVQL | 13 |
| 207 | QEAQAGKKKR | 13 |
| 225 | PEDLEFTDMG | 13 |
| 228 | LEFTDMGGNV | 13 |
| 231 | TDMGGNVYIL | 13 |
| 271 | PEPLEKPSRP | 13 |
| 275 | EKPSRPKTSF | 13 |
| 277 | PSRPKTSFNW | 13 |
| 297 | FIWRRYWRTL | 13 |
| 299 | WRRYWRTLVL | 13 |
| 300 | RRYWRTLVLL | 13 |
| 307 | VLLLL300VL | 13 |
| 316 | LLTVFLLLVF | 13 |
| 331 | QISQVIFRPL | 13 |
| 12 | APPPVDIKPR | 12 |
| 23 | PISYELRVVI | 12 |
| 24 | ISYELRVVIW | 12 |
| 37 | DVVLDDENPL | 12 |

TABLE XLIV-continued

158P3D2v.1-B4402-10-mers
Each peptide is a portion of SEQ ID NO: 3;
each start position is specified, the
length of the peptide is 10 amino acids,
and the end position for each peptide is
the start position plus nine.

| | | |
|---|---|---|
| 76 | FNSLTGEGNF | 12 |
| 78 | SLTGEGNFNW | 12 |
| 81 | GEGNFNWRFV | 12 |
| 84 | NFNWRFVFRF | 12 |
| 86 | NWRFVFRFDY | 12 |
| 96 | LPTEREVSVW | 12 |
| 100 | REVSVWRRSG | 12 |
| 109 | GPFALEEAEF | 12 |
| 137 | ISANDFLGSL | 12 |
| 146 | LELQLPDMVR | 12 |
| 175 | RCNLFRCRRL | 12 |
| 182 | RRLR180GWW | 12 |
| 197 | KEAEDVEREA | 12 |
| 221 | RKGRPEDLEF | 12 |
| 256 | VEEAEKRPVG | 12 |
| 265 | GKGRKQPEPL | 12 |
| 290 | PLKTFVFFIW | 12 |
| 311 | L300VLLTVF | 12 |
| 317 | LTVFLLLVFY | 12 |
| 319 | VFLLLVFYTI | 12 |
| 323 | LVFYTIPGQI | 12 |

TABLE XLV

158P3D2v.1-
B5101-10-mers

No Results Found.

TABLE XLVII

58P3D2v.1-DRB10101-15-mers
Each peptide is a portion of SEQ ID NO: 3;
each start position is specified, the
length of the peptide is 15 amino acids,
and the end position for each peptide is
the start position plus fourteen.

| | | |
|---|---|---|
| 124 | 20VLVLQVWDYDRIS | 1761625427 |
| 249 | 240ELLTVEEAEKRP | 1761625412 |
| 123 | 120VLVLQVWDYDRI | 1381322595 |
| 186 | 180GWWPVVKLKEAE | 1381322580 |
| 188 | 0GWWPVVKLKEAEDV | 1346719884 |

TABLE XLVII-continued

58P3D2v.1-DRB10101-15-mers
Each peptide is a portion of SEQ ID NO: 3;
each start position is specified, the
length of the peptide is 15 amino acids,
and the end position for each peptide is
the start position plus fourteen.

| | | |
|---|---|---|
| 313 | 00VLLTVFLLLVFYT | 1346719881 |
| 251 | 0ELLTVEEAEKRPVG | 1346719878 |
| 314 | 0VLLTVFLLLVFYTI | 1346719876 |
| 125 | 0VLVLQVWDYDRISA | 1346719873 |
| 62 | 0KGLEHDKQETDVHF | 1346719867 |
| 312 | 300VLLTVFLLLVFY | 1315204214 |
| 187 | 80GWWPVVKLKEAED | 609485086 |
| 250 | 40ELLTVEEAEKRPV | 2911600 |
| 300 | RRYWRTLVLLLL300 | 36 |
| 131 | VWDYDRISANDFLGS | 32 |
| 322 | LLVFYTIPGQISQVI | 32 |
| 285 | NWFVNPLKTFVFFIW | 31 |
| 305 | TLVLLLL300VLLTV | 31 |
| 73 | DVHFNSLTGEGNFNW | 29 |
| 143 | LGSLELQLPDMVRGA | 29 |
| 234 | GGNVYILTGKVEAEF | 28 |
| 245 | EAEF240ELLTVEEA | 28 |
| 325 | FYTIPGQISQVIFRP | 28 |
| 102 | VSVWRRSGPFALEEA | 27 |
| 181 | CRRLR180GWWPVVK | 27 |
| 191 | WPVVKLKEAEDVERE | 27 |
| 317 | LTVFLLLVFYTIPGQ | 27 |
| 27 | ELRVVIWNTEDVVLD | 26 |
| 151 | PDMVRGARGPELCSV | 26 |
| 227 | DLEFTDMGGNVYILT | 26 |
| 140 | NDFLGSLELQLPDMV | 25 |
| 237 | VYILTGKVEAEF240 | 25 |
| 304 | RTLVLLLL300VLLT | 25 |
| 3 | IDIFPQDVPAPPPVD | 24 |
| 90 | VFRFDYLPTEREVSV | 24 |
| 101 | EVSVWRRSGPFALEE | 24 |
| 137 | ISANDFLGSLELQLP | 24 |
| 308 | LLLL300VLLTVFLL | 24 |
| 318 | TVFLLLVFYTIPGQI | 24 |
| 43 | ENPLTGEMSSDIYVK | 23 |
| 329 | PGQISQVIFRPLHK3 | 23 |
| 2 | WIDIFPQDVPAPPPV | 22 |

TABLE XLVII-continued

58P3D2v.1-DRB10101-15-mers
Each peptide is a portion of SEQ ID NO: 3;
each start position is specified, the
length of the peptide is 15 amino acids,
and the end position for each peptide is
the start position plus fourteen.

| | | |
|---|---|---|
| 4 | DIFPQDVPAPPPVDI | 22 |
| 7 | PQDVPAPPPVDIKPR | 22 |
| 12 | APPPVDIKPRQPISY | 22 |
| 120 | QPA120VLVLQVWDY | 22 |
| 156 | GARGPELCSVQLARN | 22 |
| 233 | MGGNVYILTGKVEAE | 22 |
| 310 | LL300VLLTVFLLLV | 22 |
| 321 | LLLVFYTIPGQISQV | 22 |
| 296 | FFIWRRYWRTLVLLL | 21 |
| 86 | NWRFVFRFDYLPTER | 20 |
| 108 | SGPFALEEAEFRQPA | 20 |
| 115 | EAEFRQPA120VLVL | 20 |
| 149 | QLPDMVRGARGPELC | 20 |
| 235 | GNVYILTGKVEAEF2 | 20 |
| 284 | FNWFVNPLKTFVFFI | 20 |
| 13 | PPPVDIKPRQPISYE | 19 |
| 49 | EMSSDIYVKSWV60K | 19 |
| 52 | SDIYVKSWV60KGLE | 19 |
| 56 | VKSWV60KGLEHDKQ | 19 |
| 40 | LDDENPLTGEMSSDI | 25 |
| 82 | EGNFNWRFVFRFDYL | 19 |
| 84 | NENWREVERFDYLPT | 19 |
| 92 | RFDYLPTEREVSVWR | 19 |
| 161 | ELCSVQLARNGAGPR | 19 |
| 190 | WWPVVKLKEAEDVER | 19 |
| 283 | SFNWFVNPLKTFVFF | 19 |
| 35 | TEDVVLDDENPLTGE | 18 |
| 99 | EREVSVWRRSGPFAL | 18 |
| 110 | PFALEEAEFRQPA12 | 18 |
| 117 | EFRQPA120VLVLQV | 18 |
| 134 | YDRISANDFLGSLEL | 18 |
| 139 | ANDFLGSLELQLPDM | 18 |
| 163 | CSVQLARNGAGPRCN | 18 |
| 198 | EAEDVEREAQEAQAG | 18 |
| 217 | KQRRRKGRPEDLEFT | 18 |
| 222 | KGRPEDLEFTDMGGN | 18 |

TABLE XLVII-continued

58P3D2v.1-DRB10101-15-mers
Each peptide is a portion of SEQ ID NO: 3;
each start position is specified, the
length of the peptide is 15 amino acids,
and the end position for each peptide is
the start position plus fourteen.

| | | |
|---|---|---|
| 253 | LLTVEEAEKRPVGKG | 18 |
| 299 | WRRYWRTLVLLLL30 | 18 |
| 303 | WRTLVLLLL300VLL | 18 |
| 306 | LVLLLL300VLLTVF | 18 |
| 311 | L300VLLTVFLLLVF | 18 |
| 331 | QISQVIFRPLHK328 | 18 |

TABLE XLVII

158P3D2v.1-DRB10301-15-mers
Each peptide is a portion of SEQ ID NO: 3;
each start position is specified, the
length of the peptide is 15 amino acids,
and the end position for each peptide is
the start position plus fourteen.

| | | |
|---|---|---|
| 187 | 80GWWPVVKLKEAED | 1755316499 |
| 62 | 0KGLEHDKQETDVHF | 1441819 |
| 314 | 0VLLTVFLLLVFYTI | 1441813 |
| 313 | 00VLLTVFLLLVFYT | 1441806 |
| 251 | 0ELLTVEEAEKRPVG | 1441805 |
| 125 | 0VLVLQVWDYDRISA | 1441804 |
| 188 | 0GWWPVVKLKEAEDV | 1441793 |
| 250 | 40ELLTVEEAEKRPV | 262164 |
| 312 | 300VLLTVFLLLVFY | 65825 |
| 35 | TEDVVLDDENPLTGE | 37 |
| 237 | VYILTGKVEAEF240 | 34 |
| 36 | EDVVLDDENPLTGEM | 30 |
| 139 | ANDFLGSLELQLPDM | 26 |
| 306 | LVLLLL300VLLTVF | 24 |
| 47 | TGEMSSDIYVKSWV6 | 23 |
| 305 | TLVLLLL300VLLTV | 21 |
| 308 | LLLL300VLLTVFLL | 21 |
| 15 | PVDIKPRQPISYELR | 20 |
| 29 | RVVIWNTEDVVLDDE | 20 |
| 245 | EAEF240ELLTVEEA | 20 |
| 285 | NWFVNPLKTFVFFIW | 20 |
| 3 | IDIFPQDVPAPPPVD | 19 |
| 76 | FNSLTGEGNFNWRFV | 19 |
| 88 | RFVFRFDYLPTEREV | 19 |
| 151 | PDMVRGARGPELCSV | 19 |

TABLE XLVII-continued

158P3D2v.1-DRB10301-15-mers
Each peptide is a portion of SEQ ID NO: 3;
each start position is specified, the
length of the peptide is 15 amino acids,
and the end position for each peptide is
the start position plus fourteen.

| | | |
|---|---|---|
| 190 | WWPVVKLKEAEDVER | 19 |
| 227 | DLEFTDMGGNVYILT | 19 |
| 13 | PPPVDIKPRQPISYE | 18 |
| 21 | RQPISYELRVVIWNT | 18 |
| 135 | DRISANDFLGSLELQ | 18 |
| 162 | LCSVQLARNGAGPRC | 18 |
| 175 | RCNLFRCRRLR180G | 18 |
| 221 | RKGRPEDLEFTDMGG | 18 |
| 253 | LLTVEEAEKRPVGKG | 18 |
| 271 | PEPLEKPSRPKTSFN | 18 |
| 295 | VFFIWRRYWRTLVLL | 18 |
| 329 | PGQISQVIFRPLHK3 | 18 |

TABLE XLVIII

158P3D2v.1-DRB10401-15-mers
Each peptide is a portion of SEQ ID NO: 3;
each start position is specified, the
length of the peptide is 15 amino acids,
and the end position for each peptide is
the start position plus fourteen.

| | | |
|---|---|---|
| 124 | 20VLVLQVWDYDRIS | 1761625419 |
| 249 | 240ELLTVEEAEKRP | 1761625411 |
| 123 | 120VLVLQVWDYDRI | 1381322593 |
| 186 | 180GWWPVVKLKEAE | 1381322585 |
| 188 | 0GWWPVVKLKEAEDV | 1346719881 |
| 62 | 0KGLEHDKQETDVHF | 1346719879 |
| 313 | 00VLLTVELLLVEYT | 1346719879 |
| 125 | 0VLVLQVWDYDRISA | 1346719873 |
| 251 | 0ELLTVEEAEKRPVG | 1346719873 |
| 314 | 0VLLTVELLLVEYTI | 1346719873 |
| 312 | 300VLLTVELLLVEY | 1315204211 |
| 187 | 80GWWPVVKLKEAED | 609485085 |
| 250 | 40ELLTVEEAEKRPV | 2911605 |
| 281 | KTSFNWFVNPLKTFV | 28 |
| 300 | RRYWRTLVLLLL300 | 28 |
| 21 | RQPISYELRVVIWNT | 26 |
| 36 | EDVVLDDENPLTGEM | 26 |
| 43 | ENPLTGEMSSDIYVK | 26 |

TABLE XLVIII-continued

158P3D2v.1-DRB10401-15-mers
Each peptide is a portion of SEQ ID NO: 3;
each start position is specified, the
length of the peptide is 15 amino acids,
and the end position for each peptide is
the start position plus fourteen.

| | | |
|---|---|---|
| 199 | AEDVEREAQEAQAGK | 26 |
| 111 | FALEEAEFRQPA120 | 24 |
| 245 | EAEF240ELLTVEEA | 24 |
| 73 | DVHFNSLTGEGNFNW | 22 |
| 84 | NFNWRFVFRFDYLPT | 22 |
| 90 | VFRFDYLPTEREVSV | 22 |
| 92 | RFDYLPTEREVSVWR | 22 |
| 129 | LQVWDYDRISANDFL | 22 |
| 296 | FFIWRRYWRTLVLLL | 22 |
| 308 | LLLL300VLLTVFLL | 22 |
| 317 | LTVFLLLVFYTIPGQ | 22 |
| 322 | LLVFYTIPGQISQVI | 22 |
| 323 | LVFYTIPGQISQVIF | 22 |
| 27 | ELRVVIWNTEDVVLD | 20 |
| 35 | TEDVVLDDENPLTGE | 20 |
| 47 | TGEMSSDIYVKSWV6 | 20 |
| 76 | FNSLTGEGNFNWRFV | 20 |
| 87 | WRFVFRFDYLPTERE | 20 |
| 93 | FDYLPTEREVSVWRR | 20 |
| 120 | QPA120VLVLQVWDY | 20 |
| 128 | VLQVWDYDRISANDF | 20 |
| 151 | PDMVRGARGPELCSV | 20 |
| 159 | GPELCSVQLARNGAG | 20 |
| 162 | LCSVQLARNGAGPRC | 20 |
| 241 | TGKVEAEF240ELLT | 20 |
| 253 | LLTVEEAEKRPVGKG | 20 |
| 271 | PEPLEKPSRPKTSFN | 20 |
| 285 | NWFVNPLKTFVFFIW | 20 |
| 292 | KTFVFFIWRRYWRTL | 20 |
| 304 | RTLVLLLL300VLLT | 20 |
| 305 | TLVLLLL300VLLTV | 20 |
| 316 | LLTVFLLLVFYTIPG | 20 |
| 319 | VFLLLVFYTIPGQIS | 20 |
| 325 | FYTIPGQISQVIFRP | 20 |
| 329 | PGQISQVIFRPLHK3 | 20 |
| 59 | WV60KGLEHDKQETD | 18 |
| 67 | HDKQETDVHFNSLTG | 18 |

TABLE XLVIII-continued

158P3D2v.1-DRB10401-15-mers
Each peptide is a portion of SEQ ID NO: 3; each start position is specified, the length of the peptide is 15 amino acids, and the end position for each peptide is the start position plus fourteen.

| | | |
|---|---|---|
| 112 | ALEEAEFRQPA120V | 18 |
| 137 | ISANDFLGSLELQLP | 18 |
| 156 | GARGPELCSVQLARN | 18 |
| 161 | ELCSVQLARNGAGPR | 18 |
| 196 | LKEAEDVEREAQEAQ | 18 |
| 202 | VEREAQEAQAGKKKR | 18 |
| 233 | MGGNVYILTGKVEAE | 18 |
| 242 | GKVEAEF240ELLTV | 18 |
| 310 | LL300VLLTVFLLLV | 18 |
| 331 | QISQVIFRPLHK328 | 18 |
| 3 | IDIFPQDVPAPPPVD | 16 |
| 30 | VVIWNTEDVVLDDEN | 16 |
| 52 | SDIYVKSWV60KGLE | 16 |
| 88 | RFVFRFDYLPTEREV | 16 |
| 102 | VSVWRRSGPFALEEA | 16 |
| 108 | SGPFALEEAEFRQPA | 16 |
| 115 | EAEFRQPA120VLVL | 16 |
| 131 | VWDYDRISANDFLGS | 16 |
| 139 | ANDFLGSLELQLPDM | 16 |
| 235 | GNVYILTGKVEAEF2 | 16 |
| 284 | FNWFVNPLKTFVFFI | 16 |
| 291 | LKTFVFFIWRRYWRT | 16 |
| 293 | TFVFFIWRRYWRTLV | 16 |
| 299 | WRRYWRTLVLLLL30 | 16 |
| 13 | PPPVDIKPRQPISYE | 15 |
| 7 | PQDVPAPPPVDIKPR | 14 |
| 25 | SYELRVVIWNTEDVV | 14 |
| 28 | LRVVIWNTEDVVLDD | 14 |
| 29 | RVVIWNTEDVVLDDE | 14 |
| 37 | DVVLDDENPLTGEMS | 14 |
| 99 | EREVSVWRRSGPFAL | 14 |
| 110 | PFALEEAEFRQPA12 | 14 |
| 126 | VLVLQVWDYDRISAN | 14 |
| 134 | YDRISANDFLGSLEL | 14 |
| 140 | NDFLGSLELQLPDMV | 14 |
| 143 | LGSLELQLPDMVRGA | 14 |

TABLE XLVIII-continued

158P3D2v.1-DRB10401-15-mers
Each peptide is a portion of SEQ ID NO: 3; each start position is specified, the length of the peptide is 15 amino acids, and the end position for each peptide is the start position plus fourteen.

| | | |
|---|---|---|
| 147 | ELQLPDMVRGARGPE | 14 |
| 150 | LPDMVRGARGPELCS | 14 |
| 175 | RCNLFRCRRLR180G | 14 |
| 190 | WWPVVKLKEAEDVER | 14 |
| 193 | VVKLKEAEDVEREAQ | 14 |
| 225 | PEDLEFTDMGGNVYI | 14 |
| 230 | FTDMGGNVYILTGKV | 14 |
| 234 | GGNVYILTGKVEAEF | 14 |
| 288 | VNPLKTFVFFIWRRY | 14 |
| 303 | WRTLVLLLL300VLL | 14 |
| 306 | LVLLLL300VLLTVF | 14 |
| 307 | VLLLL300VLLTVFL | 14 |
| 318 | TVFLLLVFYTIPGQI | 14 |
| 320 | FLLLVFYTIPGQISQ | 14 |
| 321 | LLLVFYTIPGQISQV | 14 |

TABLE XLIX

158P3D2v.1-DRB11101-15-mers
Each peptide is a portion of SEQ ID NO: 3; each start position is specified, the length of the peptide is 15 amino acids, and the end position for each peptide is the start position plus fourteen.

| | | |
|---|---|---|
| 187 | 80GWWPVVKLKEAED | 1755316517 |
| 188 | 0GWWPVVKLKEAEDV | 1441815 |
| 313 | 00VLLTVFLLLVFYT | 1441805 |
| 125 | 0VLVLQVWDYDRISA | 1441804 |
| 251 | 0ELLTVEEAEKRPVG | 1441802 |
| 314 | 0VLLTVFLLLVFYTI | 1441802 |
| 62 | 0KGLEHDKQETDVHF | 1441798 |
| 250 | 40ELLTVEEAEKRPV | 262156 |
| 312 | 300VLLTVFLLLVFY | 65811 |
| 92 | RFDYLPTEREVSVWR | 25 |
| 84 | NFNWRFVFRFDYLPT | 24 |
| 235 | GNVYILTGKVEAEF2 | 24 |
| 322 | LLVFYTIPGQISQVI | 23 |
| 147 | ELQLPDMVRGARGPE | 22 |
| 292 | KTFVFFIWRRYWRTL | 22 |
| 98 | TEREVSVWRRSGPFA | 21 |

TABLE XLIX-continued

158P3D2v.1-DRB11101-15-mers
Each peptide is a portion of SEQ ID NO: 3;
each start position is specified, the
length of the peptide is 15 amino acids,
and the end position for each peptide is
the start position plus fourteen.

| Start | Peptide | Score |
|---|---|---|
| 99 | EREVSVWRRSGPFAL | 21 |
| 128 | VLQVWDYDRISANDF | 20 |
| 161 | ELCSVQLARNGAGPR | 20 |
| 178 | LFRCRRLR180GWWP | 20 |
| 140 | NDFLGSLELQLPDMV | 19 |
| 227 | DLEFTDMGGNVYILT | 19 |
| 293 | TFVFFIWRRYWRTLV | 19 |
| 296 | FFIWRRYWRTLVLLL | 19 |
| 300 | RRYWRTLVLLLL300 | 19 |
| 305 | TLVLLLL300VLLTV | 19 |
| 318 | TVFLLLVFYTIPGQI | 19 |
| 3 | IDIFPQDVPAPPPVD | 18 |
| 90 | VFRFDYLPTEREVSV | 18 |
| 175 | RCNLFRCRRLR180G | 18 |
| 284 | FNWFVNPLKTFVFFI | 18 |
| 317 | LTVFLLLVFYTIPGQ | 18 |
| 86 | NWRFVFRFDYLPTER | 17 |
| 177 | NLFRCRRLR180GWW | 17 |
| 49 | EMSSDIYVKSWV60K | 16 |
| 67 | HDKQETDVHFNSLTG | 16 |
| 73 | DVHFNSLTGEGNFNW | 16 |
| 131 | VWDYDRISANDFLGS | 16 |
| 172 | AGPRCNLFRCRRLR1 | 16 |
| 212 | GKKKRKQRRRKGRPE | 16 |
| 214 | KKRKQRRRKGRPEDL | 16 |
| 245 | EAEF240ELLTVEEA | 16 |
| 258 | EAEKRPVGKGRKQPE | 16 |
| 330 | GQISQVIFRPLHK32 | 16 |
| 21 | RQPISYELRVVIWNT | 15 |
| 53 | DIYVKSWV60KGLEH | 15 |
| 59 | WV60KGLEHDKQETD | 15 |
| 253 | LLTVEEAEKRPVGKG | 15 |
| 254 | LTVEEAEKRPVGKGR | 15 |
| 271 | PEPLEKPSRPKTSFN | 15 |
| 13 | PPPVDIKPRQPISYE | 14 |
| 111 | FALEEAEFRQPA120 | 14 |
| 145 | SLELQLPDMVRGARG | 14 |
| 148 | LQLPDMVRGARGPEL | 14 |
| 150 | LPDMVRGARGPELCS | 14 |
| 159 | GPELCSVQLARNGAG | 14 |
| 196 | LKEAEDVEREAQEAQ | 14 |
| 260 | EKRPVGKGRKQPEPL | 14 |
| 261 | KRPVGKGRKQPEPLE | 14 |
| 268 | RKQPEPLEKPSRPKT | 14 |
| 308 | LLLL300VLLTVFLL | 14 |
| 2 | WIDIFPQDVPAPPPV | 13 |
| 12 | APPPVDIKPRQPISY | 13 |
| 25 | SYELRVVIWNTEDVV | 13 |
| 34 | NTEDVVLDDENPLTG | 13 |
| 47 | TGEMSSDIYVKSWV6 | 13 |
| 110 | PFALEEAEFRQPA12 | 13 |
| 176 | CNLFRCRRLR180GW | 13 |
| 234 | GGNVYILTGKVEAEF | 13 |
| 281 | KTSFNWFVNPLKTFV | 13 |
| 285 | NWFVNPLKTFVFFIW | 13 |
| 291 | LKTFVFFIWRRYWRT | 13 |
| 316 | LLTVFLLLVFYTIPG | 13 |
| 319 | VFLLLVFYTIPGQIS | 13 |
| 329 | PGQISQVIFRPLHK3 | 13 |

TABLE XXII

158P3D2 v.18, ORF: 2932-4764,
Frame +1, 610 aa, Part A, A1-9-mers
Each peptide is a portion of SEQ ID NO: 31;
each start position is specified, the
length of the peptide is 9 amino acids,
and the end position for each peptide
is the start position plus eight.

| Start | Peptide | Score |
|---|---|---|
| 62 | PQPGCPPAY | 16 |
| 22 | RHPGQPLVR | 10 |
| 46 | KPRPAPLSC | 10 |
| 70 | YTGTVLEQT | 10 |
| 44 | ASKPRPAPL | 9 |
| 69 | AYTGTVLEQ | 9 |
| 21 | RRHPGQPLV | 8 |

TABLE XXII-continued

158P3D2 v.18, ORF: 2932-4764,
Frame +1, 610 aa, Part A, A1-9-mers
Each peptide is a portion of SEQ ID NO: 31;
each start position is specified, the
length of the peptide is 9 amino acids,
and the end position for each peptide
is the start position plus eight.

| | | |
|---|---|---|
| 30 | RSVPSWSSS | 8 |
| 36 | SSSCGWAWA | 8 |
| 52 | LSCPRICCP | 8 |
| 61 | SPQPGCPPA | 8 |
| 72 | GTVLEQTLS | 8 |
| 73 | TVLEQTLSP | 8 |

TABLE XXIII

158P3D2-v.18, ORF: 2932-4764,
Frame +1, 610 aa, Part A, A0201-9-mers
Each peptide is a portion of SEQ ID NO: 31;
each start position is specified, the
length of the peptide is 9 amino acids,
and the end position for each peptide is
the start position plus eight.

| | | |
|---|---|---|
| 24 | PGQPLVRSV | 16 |
| 21 | RRHPGQPLV | 15 |
| 44 | ASKPRPAPL | 15 |
| 66 | CPPAYTGTV | 15 |
| 27 | PLVRSVPSW | 14 |
| 70 | YTGTVLEQT | 14 |
| 20 | LRRHPGQPL | 13 |
| 73 | TVLEQTLSP | 13 |
| 12 | SWQNCAFWL | 12 |
| 71 | TGTVLEQTL | 12 |
| 61 | SPQPGCPPA | 11 |
| 19 | WLRRHPGQP | 10 |
| 36 | SSSCGWAWA | 10 |
| 49 | PAPLSCPRI | 10 |
| 56 | RICCPSPQP | 10 |
| 69 | AYTGTVLEQ | 10 |
| 42 | AWASKPRPA | 9 |
| 31 | SVPSWSSSC | 8 |
| 51 | PLSCPRICC | 8 |
| 52 | LSCPRICCP | 8 |
| 65 | GCPPAYTGT | 8 |
| 67 | PPAYTGTVL | 8 |
| 68 | PAYTGTVLE | 8 |

TABLE XXIV

158P3D2-v.18,
ORF: 2932-4764,
Frame +1, 610 aa,
Part A, A0203-9-mers

No Results Found.

TABLE XXV

158P3D2 v.18, ORF: 2932-4764,
Frame +1, 610 aa, Part A, A3-9-mers
Each peptide is a portion of SEQ ID NO: 31;
each start position is specified, the
length of the peptide is 9 amino acids,
and the end position for each peptide is
the start position plus eight.

| | | |
|---|---|---|
| 19 | WLRRHPGQP | 21 |
| 28 | LVRSVPSWS | 19 |
| 22 | RHPGQPLVR | 18 |
| 73 | TVLEQTLSP | 18 |
| 31 | SVPSWSSSC | 16 |
| 38 | SCGWAWASK | 16 |
| 27 | PLVRSVPSW | 15 |
| 46 | KPRPAPLSC | 15 |
| 56 | RICCPSPQP | 15 |
| 44 | ASKPRPAPL | 13 |
| 30 | RSVPSWSSS | 12 |
| 48 | RPAPLSCPR | 12 |
| 14 | QNCAFWLRR | 11 |
| 51 | PLSCPRICC | 11 |

TABLE XXVI

158P3D2-v.18, ORF:
2932-4764, Frame +1,
Part A, 610 aa, A26,
9-mers
Each peptide is a
portion of SEQ ID
NO: 31; each start
position is specified,
the length of the
peptide is 9 amino
acids, and the end
position for each
peptide is the start
position plus eight.

| | | |
|---|---|---|
| 73 | TVLEQTLSP | 15 |
| 31 | SVPSWSSSC | 14 |
| 70 | YTGTVLEQT | 13 |
| 28 | LVRSVPSWS | 12 |
| 71 | TGTVLEQTL | 12 |
| 72 | GTVLEQTLS | 12 |
| 62 | PQPGCPPAY | 11 |

TABLE XXVI-continued

158P3D2-v.18, ORF: 2932-4764, Frame +1, Part A, A26, 9-mers
Each peptide is a portion of SEQ ID NO: 31; each start position is specified, the length of the peptide is 9 amino acids, and the end position for each peptide is the start position plus eight.

| | | |
|---|---|---|
| 10 | RSSWQNCAF | 9 |
| 12 | SWQNCAFWL | 9 |
| 20 | LRRHPGQPL | 9 |
| 27 | PLVRSVPSW | 9 |
| 44 | ASKPRPAPL | 9 |
| 67 | PPAYTGTVL | 9 |

TABLE XXVII

158P3D2-v.18, ORF: 2932-4764, Frame +1, 610 aa, Part A, B0702-9-mers
Each peptide is a portion of SEQ ID NO: 31; each start position is specified, the length of the peptide is 9 amino acids, and the end position for each peptide is the start position plus eight.

| | | |
|---|---|---|
| 67 | PPAYTGTVL | 24 |
| 63 | QPGCPPAYT | 21 |
| 61 | SPQPGCPPA | 19 |
| 66 | CPPAYTGTV | 18 |
| 20 | LRRHPGQPL | 17 |
| 23 | HPGQPLVRS | 16 |
| 46 | KPRPAPLSC | 16 |
| 44 | ASKPRPAPL | 15 |
| 48 | RPAPLSCPR | 14 |
| 26 | QPLVRSVPS | 13 |
| 54 | CPRICCPSP | 13 |
| 59 | CPSPQPGCP | 13 |
| 8 | WPRSSWQNC | 12 |
| 32 | VPSWSSSCG | 12 |
| 50 | APLSCPRIC | 12 |

TABLE XXVIII

158P3D2-v.18, ORF: 2932-4764, Frame +1 610 aa, Part A, B08-9-mers
Each peptide is a portion of SEQ ID NO: 31; each start position is specified, the length of the peptide is 9 amino acids, and the end position for each peptide is the start position plus eight.

| | | |
|---|---|---|
| 44 | ASKPRPAPL | 28 |
| 1 | MCKRRWHWP | 18 |
| 67 | PPAYTGTVL | 17 |
| 20 | LRRHPGQPL | 16 |
| 26 | QPLVRSVPS | 16 |

TABLE XXIX

158P3D2-v.18, ORF: 2932-4764, Frame +1, 610 aa, Part A, B1510-9-mers
Each peptide is a portion of SEQ ID NO: 31; each start position is specified, the length of the peptide is 9 amino acids, and the end position for each peptide is the start position plus eight.

| | | |
|---|---|---|
| 22 | RHPGQPLVR | 14 |
| 44 | ASKPRPAPL | 13 |
| 67 | PPAYTGTVL | 13 |
| 71 | TGTVLEQTL | 13 |
| 6 | WHWPRSSWQ | 12 |
| 20 | LRRHPGQPL | 11 |
| 12 | SWQNCAFWL | 10 |
| 10 | RSSWQNCAF | 8 |

TABLE XXX

158P3D2 v.18, ORF: 2932-4764,
Frame +1, 610 aa, Part A,
B2705- 9-mers
Each peptide is a portion
of SEQ ID NO: 31; each
start position is specified,
the length of the peptide
is 9 amino acids, and the
end position for each
peptide is the start
position plus eight.

| | | |
|---|---|---|
| 20 | LRRHPGQPL | 21 |
| 21 | RRHPGQPLV | 20 |
| 22 | RHPGQPLVR | 18 |
| 48 | RPAPLSCPR | 17 |
| 3 | KRRWHWPRS | 15 |
| 4 | RRWHWPRSS | 15 |
| 10 | RSSWQNCAF | 15 |
| 29 | VRSVPSWSS | 14 |
| 40 | GWAWASKPR | 14 |
| 9 | PRSSWQNCA | 13 |
| 14 | QNCAFWLRR | 13 |
| 44 | ASKPRPAPL | 13 |
| 47 | PRPAPLSCP | 13 |
| 55 | PRICCPSPQ | 13 |
| 67 | PPAYTGTVL | 13 |
| 38 | SCGWAWASK | 12 |
| 71 | TGTVLEQTL | 12 |
| 2 | CKRRWHWPR | 11 |
| 12 | SWQNCAFWL | 11 |
| 13 | WQNCAFWLR | 11 |
| 15 | NCAFWLRRH | 11 |
| 49 | PAPLSCPRI | 11 |
| 62 | PQPGCPPAY | 11 |

TABLE XXXI

158P3D2-v.18, ORF: 2932-4764,
Frame +1, 610 aa, Part A,
B2709-9-mers
Each peptide is a
portion of SEQ ID
NO: 31; each start
position is specified, the
length of the peptide is
9 amino acids, and the
end position for each
peptide is the start
position plus eight.

| | | |
|---|---|---|
| 21 | RRHPGQPLV | 24 |
| 20 | LRRHPGQPL | 20 |

TABLE XXXI-continued

158P3D2-v.18, ORF: 2932-4764,
Frame +1, 610 aa, Part A,
B2709-9-mers
Each peptide is a
portion of SEQ ID
NO: 31; each start
position is specified, the
length of the peptide is
9 amino acids, and the
end position for each
peptide is the start
position plus eight.

| | | |
|---|---|---|
| 3 | KRRWHWPRS | 14 |
| 4 | RRWHWPRSS | 14 |
| 10 | RSSWQNCAF | 12 |
| 44 | ASKPRPAPL | 12 |

TABLE XXXII

158P3D2-v.18, ORF:
2932-4764, Frame +1
610 aa, Part A,
B4402 9-mers
Each peptide is a
portion of SEQ ID
NO: 31; each start
position is specified,
the length of the
peptide is 9 amino
acids, and the end
position for each
peptide is the start
position plus eight.

| | | |
|---|---|---|
| 44 | ASKPRPAPL | 18 |
| 62 | PQPGCPPAY | 15 |
| 10 | RSSWQNCAF | 13 |
| 12 | SWQNCAFWL | 13 |
| 35 | WSSSCGWAW | 13 |
| 11 | SSWQNCAFW | 12 |
| 27 | PLVRSVPSW | 12 |
| 5 | RWHWPRSSW | 11 |
| 67 | PPAYTGTVL | 11 |
| 71 | TGTVLEQTL | 11 |
| 20 | LRRHPGQPL | 10 |
| 33 | PSWSSSCGW | 10 |
| 49 | PAPLSCPRI | 10 |

TABLE XXIII

158P3D2-v.18,
ORF: 2932-4764, Frame +1,
610 aa,
B5101-9-mers
Each peptide is a portion of SEQ ID NO: 31; each start position is specified, the length of the peptide is 9 amino acids, and the end position for each peptide is the start position plus eight.

| | | |
|---|---|---|
| 49 | PAPLSCPRI | 23 |
| 66 | CPPAYTGTV | 23 |
| 67 | PPAYTGTVL | 21 |
| 24 | PGQPLVRSV | 17 |
| 68 | PAYTGTVLE | 16 |
| 71 | TGTVLEQTL | 15 |
| 41 | WAWASKPRP | 14 |
| 50 | APLSCPRIC | 14 |
| 16 | CAFWLRRHP | 13 |
| 23 | HPGQPLVRS | 13 |
| 26 | QPLVRSVPS | 13 |
| 32 | VPSWSSSCG | 12 |
| 46 | KPRPAPLSC | 12 |

TABLE XXXIV

158P3D2-v.18,
ORF: 2932-4764, Frame +1 610 aa, Part A, A1-10-mers
Each peptide is a portion of SEQ ID NO: 31; each start position is specified, the length of the peptide is 10 amino acids, and the end position for each peptide is the start position plus nine.

| | | |
|---|---|---|
| 61 | SPQPGCPPAY | 21 |
| 72 | GTVLEQTLSP | 12 |
| 21 | RRHPGQPLVR | 11 |
| 44 | ASKPRPAPLS | 11 |

TABLE XXXV

158P3D2-v.18,
ORF: 2932-4764, Frame +1
610 aa, Part A, A0201 10-mers
Each peptide is a portion of SEQ ID NO: 31; each start position is specified, the length of the peptide is 10 amino acids, and the end position for each peptide is the start position plus nine.

| | | |
|---|---|---|
| 73 | TVLEQTLSPL | 22 |
| 19 | WLRRHPGQPL | 20 |
| 70 | YTGTVLEQTL | 18 |
| 23 | HPGQPLVRSV | 16 |
| 43 | WASKPRPAPL | 16 |
| 65 | GCPPAYTGTV | 15 |
| 11 | SSWQNCAFWL | 13 |
| 20 | LRRHPGQPLV | 13 |
| 48 | RPAPLSCPRI | 13 |
| 51 | PLSCPRICCP | 11 |
| 69 | AYTGTVLEQT | 11 |

TABLE XXXVI

158P3D2-v.18,
ORF: 2932-4764,
Frame +1
610 aa, Part A,
A0203 10-mers

No Results Found.

TABLE XXVII

158P3D2-v.18,
ORF: 2932-4764,
Frame +1, 610aa,
Part A, A3-10-mers
Each peptide is a portion of SEQ ID NO: 31; each start position is specified, the length of the peptide is 10 amino acids, and the end position for each peptide is the start position plus nine.

| | | |
|---|---|---|
| 19 | WLRRHPGQPL | 19 |
| 21 | RRHPGQPLVR | 19 |
| 27 | PLVRSVPSWS | 18 |

TABLE XXVII-continued

158P3D2-v.18,
ORF: 2932-4764,
Frame +1, 610aa,
Part A, A3-10-mers
Each peptide is a
portion of SEQ ID
NO: 31; each start
position is
specified, the
length of the
peptide is 10
amino acids, and
the end position
for each peptide is
the start position
plus nine.

| | | |
|---|---|---|
| 37 | SSCGWAWASK | 18 |
| 73 | TVLEQTLSPL | 16 |
| 28 | LVRSVPSWSS | 15 |
| 31 | SVPSWSSSCG | 14 |
| 56 | RICCPSPQPG | 13 |
| 30 | RSVPSWSSSC | 12 |
| 46 | KPRPAPLSCP | 12 |
| 61 | SPQPGCPPAY | 12 |
| 24 | PGQPLVRSVP | 11 |
| 4 | RRWHWPRSSW | 10 |
| 18 | FWLRRHPGQP | 10 |
| 22 | RHPGQPLVRS | 10 |
| 44 | ASKPRPAPLS | 10 |
| 45 | SKPRPAPLSC | 10 |
| 51 | PLSCPRICCP | 10 |
| 66 | CPPAYTGTVL | 10 |

TABLE XXXVIII

158P3D2-v.18,
ORF: 2932-4764,
Frame +1
610 aa, Part A,
A26-10-mers
Each peptide is a
portion of SEQ ID
NO: 31; each start
position is
specified, the
length of the
peptide is 10
amino acids, and
the end position
for each peptide is
the start position
plus nine.

| | | |
|---|---|---|
| 73 | TVLEQTLSPL | 26 |
| 70 | YTGTVLEQTL | 17 |
| 72 | GTVLEQTLSP | 14 |
| 31 | SVPSWSSSCG | 13 |

TABLE XXXVIII-continued

158P3D2-v.18,
ORF: 2932-4764,
Frame +1
610 aa, Part A,
A26-10-mers
Each peptide is a
portion of SEQ ID
NO: 31; each start
position is
specified, the
length of the
peptide is 10
amino acids, and
the end position
for each peptide is
the start position
plus nine.

| | | |
|---|---|---|
| 61 | SPQPGCPPAY | 13 |

TABLE XXXIX

158P3D2-v.18,
ORF: 2932-4764,
Frame +1, 610 aa,
Part A, B0702 10-mers
Each peptide is a
portion of SEQ ID
NO:31; each start
position is
specified, the
length of the
peptide is 10
amino acids, and
the end position
for each peptide is
the start position
plus nine.

| | | |
|---|---|---|
| 66 | CPPAYTGTVL | 23 |
| 48 | RPAPLSCPRI | 20 |
| 8 | WPRSSWQNCA | 18 |
| 23 | HPGQPLVRSV | 18 |
| 43 | WASKPRPAPL | 15 |
| 46 | KPRPAPLSCP | 14 |
| 59 | CPSPQPGCPP | 14 |
| 67 | PPAYTGTVLE | 14 |
| 19 | WLRRHPGQPL | 13 |
| 50 | APLSCPRICC | 13 |
| 54 | CPRICCPSPQ | 13 |
| 61 | SPQPGCPPAY | 13 |
| 26 | QPLVRSVPSW | 12 |
| 32 | VPSWSSSCGW | 12 |

TABLE XL

158P3D2-
v.18, ORF: 2932-4764,
Frame +1, 610 aa,
Part A, B08-10-mers

No Results Found.

TABLE XLI

158P3D2-v.18,
ORF: 2932-4764, Frame
+1, 610 aa,
Part A, B1510-10-mers

No Results Found.

TABLE XLII

158P3D2-
v.18, ORF: 2932-4764,
Frame +1, 610 aa,
Part A, B2705-10-mers

No Results Found.

TABLE XLIII

158P3D2-
v.18, ORF: 2932-4764,
Frame +1, 610 aa,
Part A, B2709-10-mers

No Results Found.

TABLE XLIV

158P3D2-v.18,
ORF: 2932-4764,
Frame +1, 610 aa,
Part A, B4402-10-mers
Each peptide is a
portion of SEQ ID
NO:31; each start
position is
specified, the
length of the
peptide is 10
amino acids, and
the end position
for each peptide is
the start position
plus nine.

| | | |
|---|---|---|
| 61 | SPQPGCPPAY | 17 |
| 34 | SWSSSCGWAW | 14 |
| 9 | PRSSWQNCAF | 13 |
| 11 | SSWQNCAFWL | 12 |
| 26 | QPLVRSVPSW | 12 |
| 43 | WASKPRPAPL | 12 |
| 66 | CPPAYTGTVL | 12 |
| 70 | YTGTVLEQTL | 12 |
| 73 | TVLEQTLSPL | 12 |
| 4 | RRWHWPRSSW | 11 |
| 10 | RSSWQNCAFW | 11 |
| 19 | WLRRHPGQPL | 11 |
| 32 | VPSWSSSCGW | 11 |
| 48 | RPAPLSCPRI | 11 |
| 44 | ASKPRPAPLS | 8 |

TABLE XLV

158P3D2-
v.18, ORF: 2932-4764,
Frame +1, 610 aa,
Part A, B5101-10-mers

No Results Found.

TABLE XLVI

158P3D2-v.18, ORF: 2932-4764,
Frame +1, 610 aa, Part
A, DRB1 0101-15-mers
Each peptide is a portion
of SEQ ID NO: 31; each
start position is
specified, the length of
the peptide is 15 amino
acids, and the end
position for each peptide
is the start position plus
fouteen.

| | | |
|---|---|---|
| 26 | QPLVRSVPSWSSSCG | 30 |
| 17 | AFWLRRHPGQPLVRS | 26 |
| 16 | CAFWLRRHPGQPLVR | 24 |
| 25 | GQPLVRSVPSWSSSC | 23 |
| 57 | ICCPSPQPGCPPAYT | 22 |
| 71 | TGTVLEQTLSPLWDE | 22 |
| 23 | HPGQPLVRSVPSWSS | 21 |
| 69 | AYTGTVLEQTLSPLW | 19 |
| 32 | VPSWSSSCGWAWASK | 18 |
| 38 | SCGWAWASKPRPAPL | 18 |
| 40 | GWAWASKPRPAPLSC | 18 |
| 1 | MCKRRWHWPRSSWQN | 17 |
| 36 | SSSCGWAWASKPRPA | 17 |
| 42 | AWASKPRPAPLSCPR | 17 |
| 64 | PGCPPAYTGTVLEQT | 17 |
| 3 | KRRWHWPRSSWQNCA | 16 |
| 9 | PRSSWQNCAFWLRRH | 16 |
| 22 | RHPGQPLVRSVPSWS | 16 |
| 34 | SWSSSCGWAWASKPR | 16 |
| 41 | WAWASKPRPAPLSCP | 16 |
| 46 | KPRPAPLSCPRICCP | 16 |
| 49 | PAPLSCPRICCPSPQ | 16 |
| 70 | YTGTVLEQTLSPLWD | 16 |
| 39 | CGWAWASKPRPAPLS | 15 |

TABLE XLVII

158P3D2-v.18, ORF: 2932-4764, Frame +1, 610 aa, Part A, DRB1 0301-15-mers
Each peptide is a portion of SEQ ID NO: 31; each start position is specified, the length of the peptide is 15 amino acids, and the end position for each peptide is the start position plus fourteen.

| | | |
|---|---|---|
| 17 | AFWLRRHPGQPLVRS | 21 |
| 71 | TGTVLEQTLSPLWDE | 21 |
| 7 | HWPRSSWQNCAFWLR | 16 |
| 68 | PAYTGTVLEQTLSPL | 16 |
| 26 | QPLVRSVPSWSSSCG | 13 |
| 29 | VRSVPSWSSSCGWAW | 12 |
| 54 | CPRICCPSPQPGCPP | 12 |
| 72 | GTVLEQTLSPLWDEL | 12 |
| 25 | GQPLVRSVPSWSSSC | 11 |

TABLE XLVIII

158P3D2-v.18, ORF: 2932-4764, Frame +1, 610 aa, Part A, DRB1 0401-15-mers
Each peptide is a portion of SEQ ID NO: 31; each start position is specified, the length of the peptide is 15 amino acids, and the end position for each peptide is the start position plus fourteen.

| | | |
|---|---|---|
| 26 | QPLVRSVPSWSSSCG | 26 |
| 3 | KRRWHWPRSSWQNCA | 22 |
| 23 | HPGQPLVRSVPSWSS | 18 |
| 63 | QPGCPPAYTGTVLEQ | 18 |
| 69 | AYTGTVLEQTLSPLW | 18 |
| 15 | NCAFWLRRHPGQPLV | 17 |
| 38 | SCGWAWASKPRPAPL | 16 |
| 67 | PPAYTGTVLEQTLSP | 16 |
| 17 | AFWLRRHPGQPLVRS | 14 |
| 25 | GQPLVRSVPSWSSSC | 14 |
| 29 | VRSVPSWSSSCGWAW | 14 |
| 71 | TGTVLEQTLSPLWDE | 14 |
| 72 | GTVLEQTLSPLWDEL | 14 |

TABLE XLIX

158P3D2-v.18, ORF: 2932-4764, Frame +1, 610 aa, Part A, DRB1 1101-15-mers
Each peptide is a portion of SEQ ID NO: 31; each start position is specified, the length of the peptide is 15 amino acids, and the end position for each peptide is the start position plus fourteen.

| | | |
|---|---|---|
| 38 | SCGWAWASKPRPAPL | 26 |
| 40 | GWAWASKPRPAPLSC | 24 |
| 22 | RHPGQPLVRSVPSWS | 23 |
| 14 | QNCAFWLRRHPGQPL | 21 |
| 15 | NCAFWLRRHPGQPLV | 18 |
| 26 | QPLVRSVPSWSSSCG | 18 |
| 16 | CAFWLRRHPGQPLVR | 16 |
| 69 | AYTGTVLEQTLSPLW | 16 |
| 13 | WQNCAFWLRRHPGQP | 15 |
| 25 | GQPLVRSVPSWSSSC | 14 |
| 67 | PPAYTGTVLEQTLSP | 14 |

TABLE XXII

158P3D2-v.18, ORF: 2932-4764, Frame +1, 610 aa, Part B A1-9-mers
Each peptide is a portion of SEQ ID NO: 31; each start position is specified, the length of the peptide is 9 amino acids, and the end position for each peptide is the start position plus eight.

| | | |
|---|---|---|
| 1 | GISRQLLKH | 10 |

TABLE XXIII

158P3D2-v.18, ORF: 2932-4764, Frame +1, 610 aa, Part B, A0201-9-mers
Each peptide is a portion of SEQ ID NO: 31; each start position is specified, the length of the peptide is 9 amino acids, and the end position for each peptide is the start position plus eight.

| | | |
|---|---|---|
| 1 | GISRQLLKH | 16 |
| 6 | LLKHNFDED | 13 |
| 5 | QLLKHNFDE | 12 |

TABLE XXIV

158P3D2-
v.18, ORF: 2932-4764,
Frame +1, 610 aa, Part B,
A0203-9-mers

No Results Found.

TABLE XXIV

158P3D2-v.18,
ORF: 2932-4764,
Frame +1, 610 aa,
Part B, A3-9-mers
Each peptide is a
portion of SEQ ID
NO: 31; each start
position is specified,
the length of the
peptide is 9 amino
acids, and the end
position for each
peptide is the start
position plus eight.

| | | |
|---|---|---|
| 1 | GISRQLLKH | 18 |
| 5 | QLLKHNFDE | 14 |
| 6 | LLKHNFDED | 11 |

TABLE XXVI

158P3D2-v.18,
ORF: 2932-
4764, Frame +1,
610 aa, Part
B, A26-9-mers
Each peptide is
a portion of
SEQ ID NO: 31;
each start
position is
specified, the
length of the
peptide is 9
amino acids,
and the end
position for
each peptide is
the start
position plus
eight.

| | | |
|---|---|---|
| 1 | GISRQLLKH | 10 |
| 3 | SRQLLKHNF | 10 |
| 2 | ISRQLLKHN | 5 |

TABLE XXVII

158P3D2-v.18, ORF: 2932-4764,
Frame +1, 610 aa, Part B
B0702-9-mers
Each peptide is a portion
of SEQ ID NO: 31; each
start position is specified,
the length of the peptide is
9 amino acids, and the end
position for each peptide is
the start position plus
eight.

| | | |
|---|---|---|
| 8 | KHNFDEDEM | 7 |
| 3 | SRQLLKHNF | 6 |
| 1 | GISRQLLKH | 4 |
| 6 | LLKHNFDED | 17 |
| 4 | RQLLKHNFD | 11 |
| 3 | SRQLLKHNF | 9 |

TABLE XXVIII

158P3D2-v.18,
ORF: 2932-
4764, Frame +1,
610 aa, Part
B, B08-9-mers
Each peptide is
a portion of
SEQ ID NO: 31;
each start
position is
specified, the
length of the
peptide is 9
amino acids,
and the end
position for
each peptide is
the start
position plus
eight.

| | | |
|---|---|---|
| 6 | LLKHNFDED | 17 |
| 4 | RQLLKHNFD | 11 |
| 3 | SRQLLKHNF | 9 |

TABLE XXIX

158P3D2-v.18, ORF: 2932-4764, Frame +1, 610 aa, Part B, B1510-9-mers Each peptide is a portion of SEQ ID NO:31; each start position is specified, the length of the peptide is 9 amino acids, and the end position for each peptide is the start position plus eight.

| 8 | KHNFDEDEM | 17 |
|---|---|---|

TABLE XXX

158P3D2-v.18, ORF: 2932-4764, Frame +1, 610 aa, Part B, B2705-9-mers Each peptide is a portion of SEQ ID NO: 31; each start position is specified, the length of the peptide is 9 amino acids, and the end position for each peptide is the start position plus eight.

| 3 | SRQLLKHNF | 25 |
|---|---|---|
| 1 | GISRQLLKH | 15 |

TABLE XXXI

158P3D2-v.18, ORF: 2932-4764, Frame +1, 610 aa, Part B, B2709-9-mers Each peptide is a portion of SEQ ID NO: 31; each start position is specified, the length of the peptide is 9 amino acids, and the end position for each peptide is the start position plus eight.

| 3 | SRQLLKHNF | 19 |
|---|---|---|
| 8 | KHNFDEDEM | 11 |

TABLE XXXII

158P3D2-v.18, ORF: 2932-4764, Frame +1, 610 aa, Part B, B4402-9-mers Each peptide is a portion of SEQ ID NO: 31; each start position is specified, the length of the peptide is 9 amino acids, and the end position for each peptide is the start position plus eight.

| 3 | SRQLLKHNF | 13 |
|---|---|---|

TABLE XXXIII

158P3D2-v.18, ORF: 2932-4764, Frame +1, 610 aa, Part B, B5101 9-mers Each peptide is a portion of SEQ ID NO: 31; each start position is specified, the length of the peptide is 9 amino acids, and the end position for each peptide is the start position plus eight.

| 2 | ISRQLLKHN | 5 |
|---|---|---|
| 1 | GISRQLLKH | 4 |
| 4 | RQLLKHNFD | 4 |
| 5 | QLLKHNFDE | 4 |
| 6 | LLKHNFDED | 3 |

TABLE XXXIV

158P3D2-v.18, ORF: 2932-4764, Frame +1, 610 aa, Part B, A1-10-mers Each peptide is a portion of SEQ ID NO: 31; each start position is specified, the length of the peptide is 10 amino acids, and the end position for each peptide is the start position plus nine.

| 1 | AGISRQLLKH | 9 |
|---|---|---|

TABLE XXXV

158P3D2-v.18, ORF: 2932-4764, Frame +1, 610 aa, Part B, A0201-10-mers Each peptide is a portion of SEQ ID NO: 31; each start position is specified, the length of the peptide is 10 amino acids, and the end position for each peptide is the start position plus nine.

| 6 | QLLKHNFDED | 14 |
|---|---|---|
| 2 | GISRQLLKHN | 12 |
| 1 | AGISRQLLKH | 11 |
| 7 | LLKHNFDEDE | 11 |
| 8 | LKHNFDEDEM | 8 |

TABLE XXXVI

158P3D2-v.18, ORF: 2932-4764, Frame +1, 610 aa, Part B, A0203-10-mers

No Results Found.

TABLE XXXVII

158P3D2-v.18, ORF: 2932-4764, Frame +1, 610 aa, Part B, A3-10-mers Each peptide is a portion of SEQ ID NO: 31; each start position is specified, the length of the peptide is 10 amino acids, and the end position for each peptide is the start position plus nine.

| 6 | QLLKHNFDED | 14 |
|---|---|---|
| 1 | AGISRQLLKH | 13 |
| 2 | GISRQLLKHN | 11 |
| 7 | LLKHNFDEDE | 11 |
| 3 | ISRQLLKHNF | 9 |
| 5 | RQLLKHNFDE | 7 |

TABLE XXXVIII

158P3D2-v.18, ORF: 2932-4764, Frame +1, 610 aa, Part B, A26-10-mers Each peptide is a portion of SEQ ID NO: 31; each start position is specified, the length of the peptide is 10 amino acids, and the end position for each peptide is the start position plus nine.

| 1 | AGISRQLLKH | 11 |
|---|---|---|
| 2 | GISRQLLKHN | 8 |
| 3 | ISRQLLKHNF | 8 |

TABLE XXXIX

158P3D2-v.18, ORF: 2932-4764, Frame +1, 610 aa, Part B, B0702-10-mers Each peptide is a portion of SEQ ID NO: 31; each start position is specified, the length of the peptide is 10 amino acids, and the end position for each peptide is the start position plus nine.

| 3 | ISRQLLKHNF | 9 |
|---|---|---|
| 8 | LKHNFDEDEM | 6 |

TABLE XL

158P3D2-v.18, ORF: 2932-4764, Frame +1, 610 aa, Part B, B08-10-mers

No Results Found.

TABLE XLI

158P3D2-v.18, ORF: 2932-4764, Frame +1, 610 aa, Part B, B1510-10-mers

No Results Found.

TABLE XLVI

158P3D2-v.18, ORF: 2932-4764, Frame +1, 610 aa, Part B, DRB1 0101-15-mers

Each peptide is a portion of SEQ ID NO: 31; each start position is specified, the length of the peptide is 15 amino acids, and the end position for each peptide is the start position plus fourteen.

TABLE XLII

158P3D2-v.18, ORF: 2932-4764, Frame +1, 610 aa, Part B, B2705-10-mers

No Results Found.

TABLE XLIII

158P3D2-v.18, ORF: 2932-4764, Frame +1, 610 aa, Part B, B2709-10-mers

No Results Found.

TABLE XLIV

158P3D2-v.18, ORF: 2932-4764, Frame +1, 610 aa, Part B, B4402-10-mers Each peptide is a portion of SEQ ID NO: 31; each start position is specified, the length of the peptide is 10 amino acids, and the end position for each peptide is the start position plus nine.

| 3 | ISRQLLKHNF | 11 |
|---|---|---|
| 1 | AGISRQLLKH | 9 |

TABLE XLV

158P3D2-v.18, ORF: 2932-4764, Frame +1, 610 aa, Part B, B5101-10-mers

No Results Found.

TABLE XLVI

158P3D2-v.18, ORF: 2932-4764, Frame +1, 610 aa, Part B, DRB1 0101-15-mers Each peptide is a portion of SEQ ID NO: 31; each start position is specified, the length of the peptide is 15 amino acids, and the end position for each peptide is the start position plus fourteen.

| 14 | KHNFDEDEMDDPGDS | 19 |
|---|---|---|
| 6 | AGISRQLLKHNFDED | 18 |

TABLE XLVI-continued

| 1 | PFLAEAGISRQLLKH | 15 |
| 5 | EAGISRQLLKHNFDE | 15 |
| 2 | FLAEAGISRQLLKHN | 14 |
| 9 | SRQLLKHNFDEDEMD | 10 |

TABLE XLVII

158P3D2-v.18, ORF: 2932-4764, Frame +1, 610 aa, Part B, DRB1 0301-15-mers Each peptide is a portion of SEQ ID NO: 31; each start position is specified, the length of the peptide is 15 amino acids, and the end position for each peptide is the start position plus fourteen.

| 14 | KHNFDEDEMDDPGDS | 20 |
| 2 | FLAEAGISRQLLKHN | 17 |
| 6 | AGISRQLLKHNFDED | 17 |
| 9 | SRQLLKHNFDEDEMD | 12 |
| 5 | EAGISRQLLKHNFDE | 11 |
| 10 | RQLLKHNFDEDEMDD | 11 |
| 12 | LLKHNFDEDEMDDPG | 11 |

TABLE XLVIII

158P3D2-v.18, ORF: 2932-4764, Frame +1, 610 aa, Part B, DRB1 0401-15-mers Each peptide is a portion of SEQ ID NO: 31; each start position is specified, the length of the peptide is 15 amino acids, and the end position for each peptide is the start position plus fourteen.

| 2 | FLAEAGISRQLLKHN | 18 |
| 14 | KHNFDEDEMDDPGDS | 16 |
| 5 | EAGISRQLLKHNFDE | 14 |
| 1 | PFLAEAGISRQLLKH | 12 |
| 3 | LAEAGISRQLLKHNF | 12 |
| 7 | GISRQLLKHNFDEDE | 12 |
| 11 | QLLKHNFDEDEMDDP | 12 |

TABLE XLIX

158P3D2-v.18, ORF: 2932-4764, Frame +1, 610 aa, Part B, DRB1 1101-15-mers Each peptide is a portion of SEQ ID NO: 31; each start position is specified, the length of the peptide is 15 amino acids, and the end position for each peptide is the start position plus fourteen.

| 14 | KHNFDEDEMDDPGDS | 16 |
| 2 | FLAEAGISRQLLKHN | 15 |
| 6 | AGISRQLLKHNFDED | 14 |
| 7 | GISRQLLKHNFDEDE | 14 |

TABLE XXII

158P3D2-v.18, ORF: 2932-4764, Frame +1, 610 aa, Part C, A1-9-mers Each peptide is a portion of SEQ ID NO: 31; each start position is specified, the length of the peptide is 9 amino acids, and the end position for each peptide is the start position plus eight.

| 5 | QYEVWVQQG | 11 |
| 3 | ASQYEVWVQ | 7 |

TABLE XXIII

158P3D2-v.18, ORF: 2932-4764, Frame +1, 610 aa, Part C, A0201-9-mers Each peptide is a portion of SEQ ID NO: 31; each start position is specified, the length of the peptide is 9 amino acids, and the end position for each peptide is the start position plus eight.

| 2 | LASQYEVWV | 19 |
| 1 | GLASQYEVW | 13 |

TABLE XXIV

158P3D2-v.18 ORF: 2932-4764, Frame +1, 610 aa, Part C, A0203-9-mers

No Results Found.

TABLE XXV

158P3D2-v.18, ORF: 2932-4764, Frame +1, 610 aa, Part C, A3-9-mers Each peptide is a portion of SEQ ID NO: 31; each start position is specified, the length of the peptide is 9 amino acids, and the end position for each peptide is the start position plus eight.

| 1 | GLASQYEVW | 15 |
| 4 | SQYEVWVQQ | 14 |
| 9 | WVQQGPQEP | 13 |
| 7 | EVWVQQGPQ | 11 |

TABLE XXVI

158P3D2-v.18, ORF: 2932-4764, Frame +1, 610 aa, Part C, A26-9-mers Each peptide is a portion of SEQ ID NO: 31; each start position is specified, the length of the peptide is 9 amino acids, and the end position for each peptide is the start position plus eight.

| 7 | EVWVQQGPQ | 21 |
| 9 | WVQQGPQEP | 10 |

TABLE XXVII

158P3D2-v.18, ORF: 2932-4764, Frame +1, 610 aa, Part C, B0702-9-mers Each peptide is a portion of SEQ ID NO: 31; each start position is specified, the length of the peptide is 9 amino acids, and the end position for each peptide is the start position plus eight.

| | | |
|---|---|---|
| 10 | VQQGPQEPF | 12 |
| 2 | LASQYEVWV | 10 |

TABLE XXVIII

158P3D2-v.18, ORF: 2932-4764, Frame +1, 610 aa, Part C, B08-9-mers Each peptide is a portion of SEQ ID NO: 31; each start position is specified, the length of the peptide is 9 amino acids, and the end position for each peptide is the start position plus eight.

| | | |
|---|---|---|
| 1 | GLASQYEVW | 7 |
| 10 | VQQGPQEPF | 7 |
| 2 | LASQYEVWV | 5 |
| 4 | SQYEVWVQQ | 5 |

TABLE XXIX

158P3D2-v.18, ORF: 2932-4764, Frame +1, 610 aa, Part C, B1510-9-mers Each peptide is a portion of SEQ ID NO: 31; each start position is specified, the length of the peptide is 9 amino acids, and the end position for each peptide is the start position plus eight.

| | | |
|---|---|---|
| 10 | VQQGPQEPF | 8 |
| 1 | GLASQYEVW | 4 |
| 2 | LASQYEVWV | 4 |
| 9 | WVQQGPQEP | 4 |

TABLE XXX

158P3D2-v.18, ORF: 2932-4764, Frame +1, 610 aa, Part C, B2705-9-mers Each peptide is a portion of SEQ ID NO: 31; each start position is specified, the length of the peptide is 9 amino acids, and the end position for each peptide is the start position plus eight.

| | | |
|---|---|---|
| 10 | VQQGPQEPF | 15 |

TABLE XXXI

158P3D2-v.18, ORF: 2932-4764, Frame +1, 610 aa, Part C, B2709-9-mers Each peptide is a portion of SEQ ID NO: 31; each start position is specified, the length of the peptide is 9 amino acids, and the end position for each peptide is the start position plus eight.

| | | |
|---|---|---|
| 2 | LASQYEVWV | 9 |
| 10 | VQQGPQEPF | 8 |

TABLE XXXII

158P3D2-v.18, ORF: 2932-4764, Frame +1, 610 aa, Part C, B4402-9-mers Each peptide is a portion of SEQ ID NO: 31; each start position is specified, the length of the peptide is 9 amino acids, and the end position for each peptide is the start position plus eight.

| | | |
|---|---|---|
| 1 | GLASQYEVW | 11 |
| 10 | VQQGPQEPF | 11 |
| 6 | YEVWVQQGP | 10 |

TABLE XXXIII

158P3D2-v.18, ORF: 2932-4764, Frame +1, 610 aa, Part C, B1501-9-mers Each peptide is a portion of SEQ ID NO: 31; each start position is specified, the length of the peptide is 9 amino acids, and the end position for each peptide is the start position plus eight.

| | | |
|---|---|---|
| 2 | LASQYEVWV | 22 |

TABLE XXXIV

158P3D2-v.18, ORF: 2932-4764, Frame +1, 610 aa, Part C, A1-10-mers Each peptide is a portion of SEQ ID NO: 31; each start position is specified, the length of the peptide is 10 amino acids, and the end position for each peptide is the start position plus nine.

| | | |
|---|---|---|
| 6 | QYEVWVQQGP | 10 |
| 4 | ASQYEVWVQQ | 5 |

TABLE XXXV

158P3D2-v.18, ORF: 2932-4764, Frame +1, 610 aa, Part C, A0201-10-mers Each peptide is a portion of SEQ ID NO: 31; each start position is specified, the length of the peptide is 10 amino acids, and the end position for each peptide is the start position plus nine.

| | | |
|---|---|---|
| 2 | GLASQYEVWV | 25 |

TABLE XXXVI

158P3D2-v.18, ORF: 2932-4764, Frame +1, 610 aa, Part C, A0203-10-mers

No Results Found.

TABLE XXXVII

158P3D2-v.18, ORF: 2932-4764, Frame +1, 610 aa, Part C, A3-10-mers Each peptide is a portion of SEQ ID NO: 31; each start position is specified, the length of the peptide is 10 amino acids, and the end position for each peptide is the start position plus nine.

| | | |
|---|---|---|
| 2 | GLASQYEVWV | 16 |
| 8 | EVWVQQGPQE | 16 |

TABLE XXXVII-continued

| 10 | WVQQGPQEPF | 14 |
| 4 | ASQYEVWVQQ | 10 |
| 5 | SQYEVWVQQG | 9 |
| 1 | CGLASQYEVW | 8 |

TABLE XXXVIII

158P3D2-v.18, ORF: 2932-4764, Frame +1,
610 aa, Part C, A26-10-mers
Each peptide is a portion of SEQ ID NO: 31;
each start position is specified,
the length of the peptide is 10 amino acids,
and the end position for each peptide
is the start position plus nine.

| 8 | EVWVQQGPQE | 22 |
| 10 | WVQQGPQEPF | 18 |

TABLE XXXIX

158P3D2-v.18, ORF: 2932-4764, Frame +1,
610 aa, Part C, B0702-10-mers
Each peptide is a portion of SEQ ID NO: 31;
each start position is specified,
the length of the peptide is 10 amino acids,
and the end position for each peptide
is the start position plus nine.

| 2 | GLASQYEVWV | 9 |
| 10 | WVQQGPQEPF | 7 |

TABLE XL

158P3D2-v.18, ORF: 2932-4764, Frame +1, 610 aa, Part C, B08-10-mers

No Results Found.

TABLE XLI

158P3D2-v.18, ORF: 2932-4764, Frame +1, 610 aa, Part C, B1510-10-mers

No Results Found.

TABLE XLII

158P3D2-v.18, ORF: 2932-4764, Frame +1, 610 aa, Part C, B2705-10-mers

No Results Found.

TABLE XLIII

158P3D2-v.18, ORF: 2932-4764, Frame +1, 610 aa, Part C, B2709-10-mers

No Results Found.

TABLE XLIV

158P3D2-v.18, ORF: 2932-4764, Frame +1,
610 aa, Part C, B4402-10-mers
Each peptide is a portion of SEQ ID NO: 31;
each start position is specified,
the length of the peptide is 10 amino acids,
and the end position for each peptide
is the start position plus nine.

| 1 | CGLASQYEVW | 12 |
| 7 | YEVWVQQGPQ | 10 |
| 10 | WVQQGPQEPF | 10 |

TABLE XLV

158P3D2-v.18, ORF: 2932-4764, Frame +1, 610 aa, Part C, B5101-10-mers

No Results Found.

TABLE XLVI

158P3D2-v.18, ORF: 2932-4764, Frame +1,
610 aa, Part C, DRB1 0101-15-mers
Each peptide is a portion of SEQ ID NO: 31;
each start position is specified,
the length of the peptide is 15 amino acids,
and the end position for each peptide
is the start position plus fourteen.

| 5 | NCGLASQYEVWVQQG | 22 |
| 9 | ASQYEVWVQQGPQEP | 20 |
| 2 | HRANCGLASQYEVWV | 14 |

TABLE XLVII

158P3D2-v.18, ORF: 2932-4764, Frame +1,
610 aa, Part C, DRB1 0301-15-mers
Each peptide is a portion of SEQ ID NO: 31;
each start position is specified,
the length of the peptide is 15 amino acids,
and the end position for each peptide
is the start position plus fourteen.

| 5 | NCGLASQYEVWVQQG | 18 |
| 1 | HHRANCGLASQYEVW | 9 |

TABLE XLVIII

158P3D2-v.18, ORF: 2932-4764, Frame +1,
610 aa, Part C, DRB1 0401-15-mers
Each peptide is a portion of SEQ ID NO: 31;
each start position is specified,
the length of the peptide is 15 amino acids,
and the end position for each peptide
is the start position plus fourteen.

| | | |
|---|---|---|
| 3 | RANCGLASQYEVWVQ | 18 |
| 10 | SQYEVWVQQGPQEPF | 18 |
| 9 | ASQYEVWVQQGPQEP | 16 |
| 5 | NCGLASQYEVWVQQG | 14 |
| 2 | HRANCGLASQYEVWV | 12 |
| 7 | GLASQYEVWVQQGPQ | 12 |

TABLE XLIX

158P3D2-v.18, ORF: 2932-4764, Frame +1,
610 aa, Part C, DRB1 1101-15-mers
Each peptide is a portion of SEQ ID NO: 31;
each start position is specified,
the length of the peptide is 15 amino acids,
and the end position for each peptide
is the start position plus fourteen.

| | | |
|---|---|---|
| 9 | ASQYEVWVQQGPQEP | 19 |
| 8 | LASQYEVWVQQGPQE | 12 |

TABLE L

| Protein Characteristics of 158P3D2 v.17 | | | |
|---|---|---|---|
| 158P3D2 var.17 | Bioinformatic Program | URL on World Wide Web | Outcome |
| Protein length | | | 2036 aa |
| Transmembrane region | TM Pred | .ch.embnet.org/ | 1 TM helix 2003-2020; N-terminus intracellular (type II) |
| | HMMTop | .enzim.hu/hmmtop/ | 1 TM helix 2003-2022; N-terminus intracellular (type II) |
| | Sosui | .genome.ad.jp/SOSui/ | 1 TM helix 1999-2021 |
| | TMHMM | .cbs.dtu.dk/services/TMHMM | 1 TM helix 2000-2022; N-terminus extracellular (type I) |
| Signal Peptide | Signal P | .cbs.dtu.dk/services/SignalP/ | None |
| pI | pI/MW tool | .expasy.ch/tools/ | 5.64 |
| Molecular weight | pI/MW tool | .expasy.ch/tools/ | 227.6 kDa |
| Localization | PSORT II | psort.nibb.ac.jp/ | 26% cytoplasmic, 17% vesicles of secretory system, 13% nuclear, 13% mitochondrial, 8% plasma membrane |
| Motifs | Pfam | .sanger.ac.uk/Pfam/ | C2 domain; amino acid transporter; 7TM chemoreceptor; bradykinin; glycosyl hydrolase |
| | Prints | .biochem.ucl.ac.uk/ | C2 domain; endolaptase |
| | Blocks | .blocks.fhcrc.org/ | C2 domain |

TABLE LI

| Exon composition of transcript 158P3D2 v.1 | | |
|---|---|---|
| Exon Number | Start | End |
| Exon 1 | 1 | 836 |
| Exon 2 | 837 | 922 |
| Exon 3 | 923 | 1021 |
| Exon 4 | 1022 | 1263 |
| Exon 5 | 1264 | 1547 |
| Exon 6 | 1548 | 1648 |
| Exon 7 | 1649 | 1961 |

TABLE LII(a)

Nucleotide sequence of transcript variant 158P3D2 v.2

(SEQ ID NO: 335)

```
atcaaggccc tgggctggag gaagacatcc cagatccaga ggagctcgac tgggggtcca      60
agtactatgc gtcgctgcag gagctccagg ggcagcacaa ctttgatgaa gatgaaatgg     120
atgatcctgg agattcagat ggggtcaacc tcatttctat ggttggggag atccaagacc     180
agggtgaggc tgaagtcaaa ggcactgtgt ccccaaaaaa agcagttgcc accctgaaga     240
```

TABLE LII(a)-continued

Nucleotide sequence of transcript variant 158P3D2 v.2

```
tctacaacag gtccctggag gaagaattta accactttga agactggctg aatgtgtttc    300
ctctgtaccg agggcaaggg ggccaggatg gaggtggaga agaggaagga tctggacacc    360
ttgtgggcaa gttcaaggc tccttcctca tttaccctga atcagaggca gtgttgttct     420
ctgagcccca gatctctcgg gggatcccac agaaccggcc catcaagctc ctggtcagag    480
tgtatgttgt aaaggctacc aacctggctc ctgcagaccc caatggcaaa gcagacccct    540
acgtggtggt gagcgctggc cgggagcggc aggacaccaa ggaacgctac atccccaagc    600
agctcaaccc catctttgga gagatcctgg agctaagcat ctctctccca gctgagacgg    660
agctgacggt cgccgtattt gaacatgacc tcgtgggttc tgacgacctc atcggggaga    720
cccacattga tctggaaaac cgattctata gccaccacag agcaaactgt gggctggcct    780
cccagtatga agtgtgggtc cagcagggcc cacaggagcc attctgagtt tctggccaaa    840
cacattcaag ctcacattcc cttttgtgtc tccagatcct atgatttcat ggaaggggac    900
cctcccaccc accgccactg ccaaccaaga catagctcag tggtcaagac ttgggcttgg    960
gagtcgggat cctgtaacga atgtcacttg accgctttct ttttttatga acagtctcg    1020
ctctgtctcc caggttggag tgcagtggca cgatctcggc tgactgcaac ctccacctcc   1080
tgggttcaag cgattctcct gcctcagcct ccccagtagc tgggattaca ggcgtgggcc   1140
cccatgtcca gctaattttt atattttcgc tctgtctccc aggttggagt gcagtggcac   1200
gatctcggct gactgcaacc tccacctcct gggttcaagc gattctcctg cctcagcctc   1260
cccagtagct gggattacag gcgtgggccc ccatgtccag ctaattttta tattttagt    1320
agagacaggg tttcaccatg ttgtccaggc tggtcttgaa cccctgacct caagtgatcc   1380
acccacctct gcctcccaaa gtgctgggat tacaggtgtg agccaccatg ccaggccctc   1440
ttaacctctt caagtctgtt ttctcatctg caaaacagag gtaataagat cagtatcttc   1500
ttaatgaag cacctgggct acatttttt cattcattgt tatcataaat gaggactaac    1560
ctgtctcccg ttgggagttt tgaacctaga cctcatgtct tcatgacgtc atcactgccc   1620
caggcccagc tgtgtcccta caccagcccc agctgacgca tcttctttt ctgcctgtag    1680
agatggttac aatgcctggc gtgatgcatt ctggccttcg cagatcctgg cggggctgtg   1740
ccaacgctgt ggcctccctg ccctgaata ccgagccggt gctgtcaagg tgggcagcaa    1800
agtcttcctg acaccaccgg agaccctgcc cccagggatc tcttcacatg tggattgaca   1860
tctttcctca agatgtgcct gctccacccc cagttgacat caagcctcgg cagccaatca   1920
gctatgagct cagagttgtc atctggaaca cggaggatgt ggttctggat gacgagaatc   1980
cactcaccgg agagatgtcg agtgacatct atgtgaagag ctgggtgaag gggttggagc   2040
atgacaagca ggagacagac gttcacttca actccctgac tggggagggg aacttcaatt   2100
ggcgctttgt gttccgcttt gactacctgc ccacggagcg ggaggtgagc gtctggcgca   2160
ggtctggacc ctttgccctg gaggaggcgg agttccggca gcctgcagtg ctggtcctgc   2220
aggatccctg gagttgcagc taccagacat ggtgcgtggg gcccgggcc ccgagctctg    2280
ctctgtgcag ctggcccgca atggggccgg gccgaggtgc aatctgtttc gctgccgccg   2340
cctgaggggc tggtggccgg tagtgaagct gaaggaggca gaggacgtgg agcgggaggc   2400
gcaggaggct caggctggca agaagaagcg aaagcagagg aggaggaagg gccggccaga   2460
agacctggga ttcacagaca tgggtggcaa tgtgtacatc ctcacgggca aggtggaggc   2520
agagtttgag ctgctgactg tggaggaggc cgagaaacgg ccagtgggga aggggcggaa   2580
```

TABLE LII(a)-continued

Nucleotide sequence of transcript variant 158P3D2 v.2

```
gcagccagag cctctggaga aacccagccg ccccaaaact tccttcaact ggtttgtgaa   2640
cccgctgaag acctttgtct tcttcatctg gcgccggtac tggcgcaccc tggtgctgct   2700
gctactggtg ctgctcaccg tcttcctcct cctggtcttc tacaccatcc ctggccagat   2760
cagccaggtc atcttccgtc ccctccacaa gtgactctcg ctgaccttgg acactcaccc   2820
agggtgccaa cccttcaatg cctgctcctg gaagtctttc ttacccatgt gagctacccc   2880
agagtctagt gcttcctctg aataaaccta tcacagcc                           2918
```

TABLE LIII(a)

Nucleotide sequence alignment of 121P1F1 v.1 (SEQ ID NO: 336) and 158P3D2 v.2 (SEQ ID NO: 337)

```
Score = 2348 bits (1221), Expect = 0.0 Identities = 1223/1224 (99%)
Strand = Plus/Plus V.1:     1 ttttttttatgaaacagtctcgctctgtctcccaggttggagtgcagtggcacgatctcgg   60
           ||||||||||||||||||||||||||||||||||||||||||||||||||||||||||||
V.14:1000 ttttttttatgaaacagtctcgctctgtctcccaggttggagtgcagtggcacgatctcgg 1059

V.1:    61 ctgactgcaacctccacctcctgggttcaagcgattctcctgcctcagcctccccagtag  120
           ||||||||||||||||||||||||||||||||||||||||||||||||||||||||||||
V.14:1060 ctgactgcaacctccacctcctgggttcaagcgattctcctgcctcagcctccccagtag 1119

V.1:   121 ctgggattacaggcgtgggcccccatgtccagctaattttttatattttcgctctgtctcc  180
           ||||||||||||||||||||||||||||||||||||||||||||||||||||||||||||
V.14:1120 ctgggattacaggcgtgggcccccatgtccagctaattttttatattttcgctctgtctcc 1179

V.1:   181 caggttggagtgcagtggcacgatctcggctgactgcaacctccacctcctgggttcaag  240
           ||||||||||||||||||||||||||||||||||||||||||||||||||||||||||||
V.14:1180 caggttggagtgcagtggcacgatctcggctgactgcaacctccacctcctgggttcaag 1239

V.1:   241 cgattctcctgcctcagcctccccagtagctgggattacaggcgtgggcccccatgtcca  300
           ||||||||||||||||||||||||||||||||||||||||||||||||||||||||||||
V.14:1240 cgattctcctgcctcagcctccccagtagctgggattacaggcgtgggcccccatgtcca 1299

V.1:   301 gctaattttatatttttagtagagacagggtttcaccatgttgtccaggctggtcttga  360
           ||||||||||||||||||||||||||||||||||||||||||||||||||||||||||||
V.14:1300 gctaattttatatttttagtagagacagggtttcaccatgttgtccaggctggtcttga 1359

V.1:   361 accccttgacctcaagtgatccacccacctctgcctcccaaagtgctgggattacaggtgt  420
           ||||||||||||||||||||||||||||||||||||||||||||||||||||||||||||
V.14:1360 accccttgacctcaagtgatccacccacctctgcctcccaaagtgctgggattacaggtgt 1419

V.1:   421 gagccaccatgccaggccctcttaacctcttcaagtctgttttctcatctgcaaaacaga  480
           ||||||||||||||||||||||||||||||||||||||||||||||||||||||||||||
V.14:1420 gagccaccatgccaggccctcttaacctcttcaagtctgttttctcatctgcaaaacaga 1479

V.1:   481 ggtaataagatcagtatcttcttaatggaagcacctggactacatttttttcattcattg  540
           ||||||||||||||||||||||||||||||||||||||||||||||||||||||||||||
V.14:1480 ggtaataagatcagtatcttcttaatggaagcacctggactacatttttttcattcattg 1539

V.1:   541 ttatcataaatgaggactaacctgtctcccgttgggagttttgaacctagacctcatgtc  600
           ||||||||||||||||||||||||||||||||||||||||||||||||||||||||||||
V.14:1540 ttatcataaatgaggactaacctgtctcccgttgggagttttgaacctagacctcatgtc 1599
```

TABLE LIII(a)-continued

Nucleotide sequence alignment of 121P1F1 v.1 (SEQ ID NO: 336) and 158P3D2 v.2 (SEQ ID NO: 337)

```
V.1:    601 ttcatgacgtcatcactgccccaggcccagctgtgtccctacaccagccccagctgacgc  660
            ||||||||||||||||||||||||||||||||||||||||||||||||||||||||||||
V.14:1600 ttcatgacgtcatcactgccccaggcccagctgtgtccctacaccagccccagctgacgc 1659

V.1:    661 atcttcttttttctgcctgtagagatggttacaatgcctggcgtgatgcattctggccttc  720
            ||||||||||||||||||||||||||||||||||||||||||||||||||||||||||||
V.14:1660 atcttcttttttctgcctgtagagatggttacaatgcctggcgtgatgcattctggccttc 1719

V.1:    721 gcagatcctggcggggctgtgccaacgctgtggcctccctgcccctgaataccgagccgg  780
            ||||||||||||||||||||||||||||||||||||||||||||||||||||||||||||
V.14:1720 gcagatcctggcggggctgtgccaacgctgtggcctccctgcccctgaataccgagccgg 1779

V.1:    781 tgctgtcaaggtgggcagcaaagtcttcctgacaccaccggagaccctgcccccagggat  840
            ||||||||||||||||||||||||||||||||||||||||||||||||||||||||||||
V.14:1780 tgctgtcaaggtgggcagcaaagtcttcctgacaccaccggagaccctgcccccagggat 1839

V.1:    841 ctcttcacatgtggattgacatctttcctcaagatgtgcctgctccacccccagttgaca  900
            ||||||||||||||||||||||||||||||||||||||||||||||||||||||||||||
V.14:1840 ctcttcacatgtggattgacatctttcctcaagatgtgcctgctccacccccagttgaca 1899

V.1:    901 tcaagcctcggcagccaatcagctatgagctcagagttgtcatctggaacacggaggatg  960
            ||||||||||||||||||||||||||||||||||||||||||||||||||||||||||||
V.14:1900 tcaagcctcggcagccaatcagctatgagctcagagttgtcatctggaacacggaggatg 1959

V.1:    961 tggttctggatgacgagaatccactcaccggagagatgtcgagtgacatctatgtgaaga 1020
            ||||||||||||||||||||||||||||||||||||||||||||||||||||||||||||
V.14:1960 tggttctggatgacgagaatccactcaccggagagatgtcgagtgacatctatgtgaaga 2019

V.1:   1021 gctgggtgaaggggttggagcatgacaagcaggagacagacgttcacttcaactccctga 1080
            ||||||||||||||||||||||||||||||||||||||||||||||||||||||||||||
V.14:2020 gctgggtgaaggggttggagcatgacaagcaggagacagacgttcacttcaactccctga 2079

V.1:   1081 ctggggaggggaacttcaattggcgctttgtgttccgctttgactacctgcccacggagc 1140
            ||||||||||||||||||||||||||||||||||||||||||||||||||||||||||||
V.14:2080 ctggggaggggaacttcaattggcgctttgtgttccgctttgactacctgcccacggagc 2139

V.1:   1141 gggaggtgagcgtctggcgcaggtctggacccttttgccctggaggaggcggagttccggc 1200
            ||||||||||||||||||||||||||||||||||||||||||||||||||||||||||||
V.14:2140 gggaggtgagcgtctggcgcaggtctggacccttttgccctggaggaggcggagttccggc 2199

V.1:   1201 agcctgcagtgctggtcctgcagg                                     1224
            ||||||||||||||||||||||||
V.14:2200 agcctgcagtgctggtcctgcagg                                     2223

Score = 1340 bits (697), Expect = 0.0  Identites = 697/697 (100%)
Strand = Plus/Plus V.1:   1263 ggatccctggagttgcagctaccagacatggtgcgtggggcccggggccccgagctctgc 1322
            ||||||||||||||||||||||||||||||||||||||||||||||||||||||||||||
V.14:2222 ggatccctggagttgcagctaccagacatggtgcgtggggcccggggccccgagctctgc 2281

V.1:   1323 tctgtgcagctggcccgcaatggggccgggccgaggtgcaatctgtttcgctgccgccgc 1382
            ||||||||||||||||||||||||||||||||||||||||||||||||||||||||||||
V.14:2282 tctgtgcagctggcccgcaatggggccgggccgaggtgcaatctgtttcgctgccgccgc 2341
```

TABLE LIII(a)-continued

Nucleotide sequence alignment of 121P1F1 v.1 (SEQ ID NO: 336) and 158P3D2 v.2 (SEQ ID NO: 337)

```
V.1: 1383  ctgaggggctggtggccggtagtgaagctgaaggaggcagaggacgtggagcgggaggcg  1442
           ||||||||||||||||||||||||||||||||||||||||||||||||||||||||||||
V.14:2342  ctgaggggctggtggccggtagtgaagctgaaggaggcagaggacgtggagcgggaggcg  2401

V.1: 1443  caggaggctcaggctggcaagaagaagcgaaagcagaggaggaggaagggccggccagaa  1502
           ||||||||||||||||||||||||||||||||||||||||||||||||||||||||||||
V.14:2402  caggaggctcaggctggcaagaagaagcgaaagcagaggaggaggaagggccggccagaa  2461

V.1: 1503  gacctggagttcacagacatgggtggcaatgtgtacatcctcacgggcaaggtggaggca  1562
           ||||||||||||||||||||||||||||||||||||||||||||||||||||||||||||
V.14:2462  gacctggagttcacagacatgggtggcaatgtgtacatcctcacgggcaaggtggaggca  2521

V.1: 1563  gagtttgagctgctgactgtggaggaggccgagaaacggccagtggggaaggggcggaag  1622
           ||||||||||||||||||||||||||||||||||||||||||||||||||||||||||||
V.14:2522  gagtttgagctgctgactgtggaggaggccgagaaacggccagtggggaaggggcggaag  2581

V.1: 1623  cagccagagcctctggagaaacccagccgccccaaaacttccttcaactggtttgtgaac  1682
           ||||||||||||||||||||||||||||||||||||||||||||||||||||||||||||
V.14:2582  cagccagagcctctggagaaacccagccgccccaaaacttccttcaactggtttgtgaac  2641

V.1: 1683  ccgctgaagacctttgtcttcttcatctggcgccggtactggcgcaccctggtgctgctg  1742
           ||||||||||||||||||||||||||||||||||||||||||||||||||||||||||||
V.14:2642  ccgctgaagacctttgtcttcttcatctggcgccggtactggcgcaccctggtgctgctg  2701

V.1: 1743  ctactggtgctgctcaccgtcttcctcctcctggtcttctacaccatccctggccagatc  1802
           ||||||||||||||||||||||||||||||||||||||||||||||||||||||||||||
V.14:2702  ctactggtgctgctcaccgtcttcctcctcctggtcttctacaccatccctggccagatc  2761

V.1: 1803  agccaggtcatcttccgtcccctccacaagtgactctcgctgaccttggacactcaccca  1862
           ||||||||||||||||||||||||||||||||||||||||||||||||||||||||||||
V.14:2762  agccaggtcatcttccgtcccctccacaagtgactctcgctgaccttggacactcaccca  2821

V.1: 1863  gggtgccaacccttcaatgcctgctcctggaagtctttcttacccatgtgagctacccca  1922
           ||||||||||||||||||||||||||||||||||||||||||||||||||||||||||||
V.14:2822  gggtgccaacccttcaatgcctgctcctggaagtctttcttacccatgtgagctacccca  2881

V.1: 1923  gagtctagtgcttcctctgaataaacctatcacagcc                          1959
           |||||||||||||||||||||||||||||||||||||
V.14:2882  gagtctagtgcttcctctgaataaacctatcacagcc                          2918
```

TABLE LIV(a)

Peptide sequences of protein coded by 158P3D2 v.2

>158P3D2 v.2A
(SEQ ID NO: 338)
```
MDDPGDSDGV NLISMVGEIQ DQGEAEVKGT VSPKKAVATL KIYNRSLEEE FNHFEDWLNV   60
FPLYRGQGGQ DGGGEEEGSG HLVGKFKGSF LIYPESEAVL FSEPQISRGI PQNRPIKLLV  120
RVYVVKATNL APADPNGKAD PYVVVSAGRE RQDTKERYIP KQLNPIFGEI LELSISLPAE  180
TELTVAVFEH DLVGSDDLIG ETHIDLENRF YSHHRANCGL ASQYEVWVQQ GPQEPF      236
```

>158P3D2 v.2B
(SEQ ID NO: 339)
```
MVRGARGPEL CSVQLARNGA GPRCNLFRCR RLRGWWPVVK LKEAEDVERE AQEAQAGKKK   60
RKQRRRKGRP EDLEFTDMGG NVYILTGKVE AEFELLTVEE AEKRPVGKGR KQPEPLEKPS  120
RPKTSFNWFV NPLKTFVFFI WRRYWRTLVL LLLVLLTVFL LLVFYTIPGQ ISQVIFRPLH  180
K                                                                   181
```

TABLE LV(a)

Amino acid sequence alignment of 121P1F1 v.1 (SEQ ID NO: 340) and 158P3D2 v.2 (SEQ ID NO: 341)

Score = 372 bits (956), Expect = e-103 Identities = 181/181 (100%), Positives = 181/181 (100%)

```
V.1:  148 MVRGARGPELCSVQLARNGAGPRCNLFRCRRLRGWWPVVKLKEAEDVEREAQEAQAGKKK  207
          MVRGARGPELCSVQLARNGAGPRCNLFRCRRLRGWWPVVKLKEAEDVEREAQEAQAGKKK
V.14:   1 MVRGARGPELCSVQLARNGAGPRCNLFRCRRLRGWWPVVKLKEAEDVEREAQEAQAGKKK   60

V.1:  208 RKQRRRKGRPEDLEFTDMGGNVYILTGKVEAEFELLTVEEAEKRPVGKGRKQPEPLEKPS  267
          RKQRRRKGRPEDLEFTDMGGNVYILTGKVEAEFELLTVEEAEKRPVGKGRKQPEPLEKPS
V.14:  61 RKQRRRKGRPEDLEFTDMGGNVYILTGKVEAEFELLTVEEAEKRPVGKGRKQPEPLEKPS  120

V.1:  268 RPKTSFNWFVNPLKTFVFFIWRRYWRTLVLLLLVLLTVFLLLVFYTIPGQISQVIFRPLH  327
          RPKTSFNWFVNPLKTFVFFIWRRYWRTLVLLLLVLLTVFLLLVFYTIPGQISQVIFRPLH
V.14: 121 RPKTSFNWFVNPLKTFVFFIWRRYWRTLVLLLLVLLTVFLLLVFYTIPGQISQVIFRPLH  180

V.1:  328 K  328
          K
V.14: 181 K  181
```

Note:
Protein variant 158P3D2 v.2A does not share common sequence with protein 158P3D2 v.1.

TABLE LII(b)

Nucleotide sequence of transcript variant 158P3D2 v.14

(SEQ ID NO: 342)

```
caggtgggcg ggctggtggg cagaagggca gacgggcaga ggaagtgcca gtgccactgg    60
gaccatggct ctgacggtaa gcgtgcaacg actaacaggg ctgaccggca cccacgaccg   120
acaagtgaag ctcacctttc gaggctttac ccagaaaaca agaaaaattc actgtggtcc   180
agaagcagat atcggtgagc tgttccgatg gccccactat ggggctccac tggctgggga   240
gtgtctgtct gtgcaggtgg tcaactgcag ccgtgtattc agccttaggc ctctaggac    300
cctggtgatc tccctgcagc agctacagaa tgctgggcat tggtgctac gggaagccct    360
agtggatgag aatcttcaag tgtccccgat ccaggtggag cttgacctga agtaccagcc   420
cccagagggc gctactggag cctggtcaga ggaggacttt ggggcaccca tccaggacag   480
cttcgagtta atcatcccca atgtgggctt ccaggaactg gagcctgggg aggcccagct   540
ggagcggcgg gcagtggctc taggccgcag gctagctcga agtctaggcc agcaggacga   600
tgaagagaat gagctggagc ttgagctgga gcaggacctg gatgatgagc ctgacgtgga   660
actttctggt gttatgttca gccccctcaa gagccgcgcc agggccctgg cccatgggga   720
tcccttccag gtgtccagag ctcaagactt ccaggtggga gtcactgtgc tggaagccca   780
gaaactggtg ggagtcaaca ttaaccccta tgtggccgtg caagtggggg gcagcgccg    840
tgtgaccgcc acacagcgtg ggaccagttg ccccttctac aatgagtact tcttgttcga   900
atttcatgac acgcggcttc gtctccaaga cttgctgctg gagatcacgg tgagtgggt    960
aggggtgacc agtgtccttc agagaagggg ggatgagaaa gctgcaggac taacaccacc  1020
ttccccccaag gctttccatt cgcagaccct cccctttatg ccacccggga taggcacctt  1080
caggatggac ctgggcatca tcttggacca gccagatggc cagttctacc aaagatgggt  1140
tccgctgcat gatccccgag acacccgcgc cgggaccaag ggtttcatta aggtcacctt  1200
gtccgtgagg gcgcgcgggg acctgccccc tccaatgcta ccccggccc cagggcactg  1260
ttcggacatc gagaagaacc tgctcctgcc gcgcggggtg cccgccgaga ggccatgggc  1320
gcggctccgc gtgcgcctgt accgcgccga ggggcttccc gcgctgcgcc tggggctgct  1380
gggcagcctg gtccgcgcgcc tgcacgacca gcgcgtcctg gtggagccct atgtgcgggt  1440
```

TABLE LII(b)-continued

Nucleotide sequence of transcript variant 158P3D2 v.14

```
gtctttcctg gggcaggagg gcgagacgtc ggtgagcgcc gaggcggcgg cgcccgaatg   1500
gaacgagcag ctgagcttcg tggagctctt cccgccgctg acgcgcagcc tccgcctgca   1560
gctgcgggac gacgcgcccc tggtcgacgc ggcactcgct acgcacgtgc cggacctgag   1620
gcggatctcc catccgggcc gcgcggcggg gtttaaccct accttcggcc cggcctgggt   1680
gcccctctat ggctcgcccc ccggcgcggg gctccgggat agtcttcaag gtctcaacga   1740
aggcgttggc caaggcattt ggttccgcgg ccgccttctg ctggctgtgt ccatgcaggt   1800
gttggaaggg agagctgaac ctgagcctcc ccaggcccag caggggtcca cgttgtcccg   1860
gctcacccga agaagaaaa agaaagccag aagggatcag accccaaagg cggttccgca   1920
gcacttggac gccagccccg gtgccgaggg gcctgagatc ccccgtgcca tggaggtgga   1980
ggtggaggag ctgctgccgc tgccagagaa tgtcctggcg ccctgtgaag atttcctgct   2040
tttcggtgtg ctcttcgagg ccaccatgat cgacccacc gtggcctccc agcccatcag   2100
cttcgagatc tccattggtc gcgcaggccg tctggaggag caattgggcc gagggtccag   2160
ggctggggag ggaactgagg gtgcagccgt ggaggctcag cctctgctgg gagccaggcc   2220
agaggaggag aaagaggagg aagaactggg gacccatgct cagcggcctg agcccatgga   2280
cggcagtggg ccatacttct gcttgcccct ctgtcactgc aagccatgca tgcatgtgtg   2340
gagttgctgg gaggaccaca cctggcgcct gcagagcagc aactgcgtgc gcaaagtggc   2400
cgagaggctg gaccaggggc tgcaggaggt tgagagactg cagcgcaagc cggggcctgg   2460
cgcctgtgca cagctcaagc aggcactgga agtactggtg gctgggagca gacagttttg   2520
ccacggtgcc gagcgcagga cgatgacccg gcccaatgcc ctggatcgat gccgagggaa   2580
actcctggtg cacagcctga accttttggc taagcaagga ctgcgacttc tacgcggcct   2640
gagacggcgc aatgtgcaaa agaaggtggc actggccaag aagctcctgg caaaactgcg   2700
cttcctggct gaggagcccc agccaccccc tcccgatgtg ctggtctgga tgctcagcgg   2760
gcagcgccgt gtggcctggg cccggatccc tgcccaggat gtgctgttct ctgtggttga   2820
ggaggaacgg ggccgagact gtgggaagat ccagagtcta atgctcacgg cacccggggc   2880
agccctggt gaggtctgtg ccaagctgga gctcttcctg cggctgggcc tgggcaagca   2940
agccaaggcc tgcacctctg agctgccccc ggatttgctg cccgagccct cagccgggct   3000
gccctccagc ctacaccggg acgactttag ctacttccaa ctccgggctc acttgtacca   3060
ggcccggggt gtgttggctg cagatgacag tggcctctcg gaccccttg ctcgagtcct   3120
catctctacc cagtgtcaga ccacacgggt cctggagcag acgctgagcc ctctgtggga   3180
tgaactcctg gtatttgagc agttgatcgt ggatgggagg agggagcacc tgcaggagga   3240
gcctccatta gtgatcatca atgtatttga ccacaataag tttggccccc ccgtgttcct   3300
gggcagggca ctgccgcccc caagggtaaa gctgatggag acccatacc aacgcccaga   3360
gttgcagttc ttccccctga ggaagggacc ctgggcagcc ggagagctca ttgccgcctt   3420
tcaactcatt gaactagact acagtggccg acttgagccc tcagtgccca gtgaggtgga   3480
gccccaggat ctggcacccc tggttgagcc ccactctgga cgcctgtccc ttccacccaa   3540
cgtgtgccca gtgctcaggg agttccgtgt tgaggtgctg ttctggggtc ttaggggact   3600
tggtcgtgtg catctgctcg aggtggagca gccccaggtt gtactggagg tggctgggca   3660
aggtgtggag tctgaggtcc tggccagcta ccgtgagagc cccaatttca ctgagcttgt   3720
caggcatctg acagtggact tgccggagca gccttacttg cagcctccac tcagcatctt   3780
```

TABLE LII(b)-continued

Nucleotide sequence of transcript variant 158P3D2 v.14

```
ggtgattgag cgccgggcct ttggccacac agtccttgtg ggttcccaca ttgtccccca    3840
catgctgcga ttcacatttc ggggtcatga ggatcctcct gaggaggaag gagagatgga    3900
ggagacaggg gatatgatgc ccaagggacc tcaaggacag aagtccctgg atcccttctt    3960
ggctgaagcg ggtatatcca gacagctcct gaagcctcct ctgaagaagc tcccactagg    4020
aggcctccta aatcaaggcc ctgggctgga ggaagacatc ccagatccag aggagctcga    4080
ctggggtcc aagtactatg cgtcgctgca ggagctccag gggcagcaca actttgatga    4140
agatgaaatg gatgatcctg gagattcaga tggggtcaac ctcatttcta tggttgggga    4200
gatccaagac caggatctac aacaggtccc tgaaggaaga atttaaccac tttgaagact    4260
ggctgaatgt gtttcctctg taccgagggc aaggggggcca ggatggaggt ggagaagagg    4320
aaggatctgg acaccttgtg ggcaagttca agggctcctt cctcatttac cctgaatcag    4380
aggcagtgtt gttctctgag ccccagatct cccgggggat cccacagaac cggcccatca    4440
agctcctggt cagagtgtat gttgtaaagg ctaccaacct ggctcctgca gaccccaatg    4500
gcaaagcaga cccttacgtg gtggtgagcg ctggccggga gcggcaggac accaaggaac    4560
gctacatccc caagcagctc aaccccatct ttggagagat cctggagcta agcatctctc    4620
tcccagctga acggagctg acggtcgccg tatttgatca tgacctcgtg ggttctgacg    4680
acctcatcgg ggagacccac attgatctgg aaaaccgatt ctatagccac cacagagcaa    4740
actgtgggct ggcctcccag tatgaagtgt gggtccagca gggcccacag gagccattct    4800
gagtttctgg ccaaacacat tcaagctcac attccctttt gtgtctccag atcctatgat    4860
ttcatggaag gggaccctcc cacccaccgc cactgccaac caagacatag ctcagtggtc    4920
aagacttggg cttgggagtc gggatcctgt aacgaatgtc acttgaccgc tttctttttt    4980
tatgaaacag tctcgctctg tctcccaggt tggagtgcag tggcacgatc tcggctgact    5040
gcaacctcca cctcctgggt tcaagcgatt ctcctgcctc agcctcccca gtagctggga    5100
ttacaggcgt gggcccccat gtccagctaa ttttttatatt ttcgctctgt ctcccaggtt    5160
ggagtgcagt ggcacgatct cggctgactg caacctccac ctcctgggtt caagcgattc    5220
tcctgcctca gcctccccag tagctgggat tacaggcgtg gcccccatg tccagctaat    5280
ttttatattt ttagtagaga cagggtttca ccatgttgtc caggctggtc ttgaaccct    5340
gacctcaagt gatccaccca cctctgcctc ccaaagtgct gggattacag gtgtgagcca    5400
ccatgccagg ccctcttaac ctcttcaagt ctgttttctc atctgcaaaa cagaggtaat    5460
aagatcagta tcttcttaat ggaagcacct ggactacatt tttttcattc attgttatca    5520
taaatgagga ctaacctgtc tcccgttggg agttttgaac ctagacctca tgtcttcatg    5580
acgtcatcac tgccccaggc ccagctgtgt ccctacacca gccccagctg acgcatcttc    5640
tttttctgcc tgtagagatg gttacaatgc ctggcgtgat gcattctggc cttcgcagat    5700
cctggcgggg ctgtgccaac gctgtggcct ccctgcccct gaataccgag ccggtgctgt    5760
caaggtgggc agcaaagtct tcctgacacc accggagacc ctgccccag ggatctcttc    5820
acatgtggat tgacatcttt cctcaagatg tgcctgctcc accccagtt gacatcaagc    5880
ctcggcagcc aatcagctat gagctcgagt tgtcatctg gaacacgag gatgtggttc    5940
tggatgacga gaatccactc accggagaga tgtcgagtga catctatgtg aagaggtagg    6000
ctgctggccg ggcggggcaa cggcggtgca ctagggggat tgcaaatggg tgtgggccct    6060
cgggctgagt ccagagcccc gaccccaggc cctccgtggt gctgagagcg gggtgaggag    6120
```

TABLE LII(b)-continued

Nucleotide sequence of transcript variant 158P3D2 v.14

```
tgggttctcc atgtagctcc agccctgacg ctcacccacc ccggcccag ctgggtgaag      6180
gggttggagc atgacaagca ggagacagac gttcacttca actccctgac tggggagggg      6240
aacttcaatt ggcgctttgt gttccgcttt gactacctgc ccacggagcg ggaggtgagc      6300
gtctggcgca ggtctggacc ctttgccctg gaggaggcgg agttccggca gcctgcagtg      6360
ctggtcctgc aggtctggga ctatgaccgc atctctgcca atgacttcct tggatccctg      6420
gagttgcagc taccagacat ggtgcgtggg gcccggggcc ccgagctctg ctctgtgcag      6480
ctggcccgca atggggccgg gccgaggtgc aatctgtttc gctgccgccg cctgaggggc      6540
tggtggccgg tagtgaagct gaaggaggca gaggacgtgg agcgggaggc gcaggaggct      6600
caggctggca agaagaagcg aaagcagagg aggaggaagg gccggccaga agacctggag      6660
ttcacagaca tgggtggcaa tgtgtacatc ctcacgggca aggtggaggc agagtttgag      6720
ctgctgactg tggaggaggc cgagaaacgg ccagtgggga aggggcggaa gcagccagag      6780
cctctggaga aacccagccg ccccaaaact tccttcaact ggtttgtgaa cccgctgaag      6840
acctttgtct tcttcatctg gcgccggtac tggcgcaccc tggtgctgct gctactggtg      6900
ctgctcaccg tcttcctcct cctggtcttc tacaccatcc ctggccagat cagccaggtc      6960
atcttccgtc ccctccacaa gtgactctcg ctgaccttgg acactcaccc agggtgccaa      7020
cccttcaatg cctgctcctg gaagtctttc ttacccatgt gagctacccc agagtctagt      7080
gcttcctctg aataaaccta tcacagcc                                         7108
```

TABLE LIII(b)

Nucleotide sequence alignment of 121P1F1 v.1 (SEQ ID NO: 343) and 158P3D2 v.14 (SEQ ID NO: 344)

```
Score = 1946 bits (1012), Expect = 0.0 Identities = 1018/1021 (99%)
Strand = Plus/Plus V.1:     1 ttttttttatgaaacagtctcgctctgtctcccaggttggagtgcagtggcacgatctcgg    60
           ||||||||||||||||||||||||||||||||||||||||||||||||||||||||||||
V.14: 4975 ttttttttatgaaacagtctcgctctgtctcccaggttggagtgcagtggcacgatctcgg 5034

V.1:    61 ctgactgcaacctccacctcctgggttcaagcgattctcctgcctcagcctccccagtag   120
           ||||||||||||||||||||||||||||||||||||||||||||||||||||||||||||
V.14: 5035 ctgactgcaacctccacctcctgggttcaagcgattctcctgcctcagcctccccagtag 5094

V.1:   121 ctgggattacaggcgtgggcccccatgtccagctaattttttatattttcgctctgtctcc   180
           ||||||||||||||||||||||||||||||||||||||||||||||||||||||||||||
V.14: 5095 ctgggattacaggcgtgggcccccatgtccagctaattttttatattttcgctctgtctcc 5154

V.1:   181 caggttggagtgcagtggcacgatctcggctgactgcaacctccacctcctgggttcaag   240
           ||||||||||||||||||||||||||||||||||||||||||||||||||||||||||||
V.14: 5155 caggttggagtgcagtggcacgatctcggctgactgcaacctccacctcctgggttcaag 5214

V.1:   241 cgattctcctgcctcagcctccccagtagctgggattacaggcgtgggcccccatgtcca   300
           ||||||||||||||||||||||||||||||||||||||||||||||||||||||||||||
V.14: 5215 cgattctcctgcctcagcctccccagtagctgggattacaggcgtgggcccccatgtcca 5274

V.1:   301 gctaattttttatattttagtagagacagggtttcaccatgttgtccaggctggtcttga   360
           ||||||||||||||||||||||||||||||||||||||||||||||||||||||||||||
V.14: 5275 gctaattttttatattttagtagagacagggtttcaccatgttgtccaggctggtcttga 5334
```

TABLE LIII(b)-continued

Nucleotide sequence alignment of 121P1F1 v.1 (SEQ ID NO: 343) and 158P3D2 v.14 (SEQ ID NO: 344)

```
V.1:     361 acccctgacctcaagtgatccacccacctctgcctcccaaagtgctgggattacaggtgt  420
             ||||||||||||||||||||||||||||||||||||||||||||||||||||||||||||
V.14:   5335 acccctgacctcaagtgatccacccacctctgcctcccaaagtgctgggattacaggtgt 5394

V.1:     421 gagccaccatgccaggcccacttaacctcttcaagtctgttttctcatctgcaaaacaga  480
             ||||||||||||||||||||||||||||||||||||||||||||||||||||||||||||
V.14:   5395 gagccaccatgccaggcccacttaacctcttcaagtctgttttctcatctgcaaaacaga 5454

V.1:     481 ggtaataagatcagtatcttcttaatggaagcacctgggctacatttttttcattcattg  540
             ||||||||||||||||||||||||||||||||||||||||||||||||||||||||||||
V.14:   5455 ggtaataagatcagtatcttcttaatggaagcacctgggctacatttttttcattcattg 5514

V.1:     541 ttatcataaatgaggactaacctgtctcccgttgggagttttgaacctagacctcatgtc  600
             ||||||||||||||||||||||||||||||||||||||||||||||||||||||||||||
V.14:   5515 ttatcataaatgaggactaacctgtctcccgttgggagttttgaacctagacctcatgtc 5574

V.1:     601 ttcatgacgtcatcactgccccaggcccagctgtgtccctacaccagcccagctgacgc  660
             ||||||||||||||||||||||||||||||||||||||||||||||||||||||||||||
V.14:   5575 ttcatgacgtcatcactgccccaggcccagctgtgtccctacaccagcccagctgacgc 5634

V.1:     661 atcttcttttctgcctgtagagatggttacaatgcctggcgtgatgcattctggccttc  720
             ||||||||||||||||||||||||||||||||||||||||||||||||||||||||||||
V.14:   5635 atcttcttttctgcctgtagagatggttacaatgcctggcgtgatgcattctggccttc 5694

V.1:     721 gcagatcctggcggggctgtgccaacgctgtggcctccctgcccctgaataccgagccgg  780
             ||||||||||||||||||||||||||||||||||||||||||||||||||||||||||||
V.14:   5695 gcagatcctggcggggctgtgccaacgctgtggcctccctgcccctgaataccgagccgg 5754

V.1:     781 tgctgtcaaggtgggcagcaaagtcttcctgacaccaccggagaccctgcccccagggat  840
             ||||||||||||||||||||||||||||||||||||||||||||||||||||||||||||
V.14:   5755 tgctgtcaaggtgggcagcaaagtcttcctgacaccaccggagaccctgcccccagggat 5814

V.1:     841 ctcttcacatgtggattgacatctttcctcaagatgtgcctgctccaccccagttgaca  900
             ||||||||||||||||||||||||||||||||||||||||||||||||||||||||||||
V.14:   5815 ctcttcacatgtggattgacatctttcctcaagatgtgcctgctccaccccagttgaca 5874

V.1:     901 tcaagcctcggcagccaatcagctatgagctcagagttgtcatctggaacacggaggatg  960
             ||||||||||||||||||||||||||||||||||||||||||||||||||||||||||||
V.14:   5875 tcaagcctcggcagccaatcagctatgagctcagagttgtcatctggaacacggaggatg 5934

V.1:     961 tggttctggacgacgagaatccactcaccggagagatgtcgagtgacatctatgtgaaga 1020
             ||||||||||||||||||||||||||||||||||||||||||||||||||||||||||||
V.14:   5935 tggttctggacgacgagaatccactcaccggagagatgtcgagtgacatctatgtgaaga 5994

V.1:    1021 g                                                            1021
             |
V.14:   5995 g                                                            5995
```

Score = 1796 bits (934), Expect = 0.0 Identities = 938/940 (99%)
Strand = Plus/Plus

```
V.1:    1020 agctgggtgaaggggttggagcatgacaagcaggagacagacgttcacttcaactccctg 1079
             ||||||||||||||||||||||||||||||||||||||||||||||||||||||||||||
V.14:   6169 agctgggtgaaggggttggagcatgacaagcaggagacagacgttcacttcaactccctg 6228

V.1:    1080 actggggaggggaacttcaattggcgctttgtgttccgctttgactacctgcccacggag 1139
             ||||||||||||||||||||||||||||||||||||||||||||||||||||||||||||
V.14:   6229 actggggaggggaacttcaattggcgctttgtgttccgctttgactacctgcccacggag 6288

V.1:    1140 cgggaggtgagcatccggcgcaggtctggaccctttgccctggaggaggcggagttccgg 1199
             ||||||||||||||||||||||||||||||||||||||||||||||||||||||||||||
V.14:   6289 cgggaggtgagcatccggcgcaggtctggaccctttgccctggaggaggcggagttccgg 6348
```

TABLE LIII(b)-continued

Nucleotide sequence alignment of 121P1F1 v.1 (SEQ ID NO: 343) and 158P3D2 v.14 (SEQ ID NO: 344)

```
V.1:   1200 cagcctgcagtgctggtcctgcaggtctgggactatgaccgcatctctgccaatgacttc 1259
             ||||||||||||||||||||||||||||||||||||||||||||||||||||||||||||
V.14:  6349 cagcctgcagtgctggtcctgcaggtctgggactatgaccgcatctctgccaatgacttc 6408

V.1:   1260 cttggatccctggagttgcagctaccagacatggtgcgtggggcccggggccccgagctc 1319
             ||||||||||||||||||||||||||||||||||||||||||||||||||||||||||||
V.14:  6409 cttggatccctggagttgcagctaccagacatggtgcgtggggcccggggccccgagctc 6468

V.1:   1320 tgctctgtgcagctggcccgcaatggggccgggccgaggtgcaatctgtttcgctgccgc 1379
             ||||||||||||||||||||||||||||||||||||||||||||||||||||||||||||
V.14:  6469 tgctctgtgcagctggcccgcaatggggccgggccgaggtgcaatctgtttcgctgccgc 6528

V.1:   1380 cgcctgaggggctggtggccggtagtgaagctgaaggaggcagaggacgtggagcgggag 1439
             ||||||||||||||||||||||||||||||||||||||||||||||||||||||||||||
V.14:  6529 cgcctgaggggctggtggccggtagtgaagctgaaggaggcagaggacgtggagcgggag 6588

V.1:   1440 gcgcaggaggctcaggctggcaagaagaagcgaaagcagaggaggaggaagggccggcca 1499
             ||||||||||||||||||||||||||||||||||||||||||||||||||||||||||||
V.14:  6589 gcgcaggaggctcaggctggcaagaagaagcgaaagcagaggaggaggaagggccggcca 6648

V.1:   1500 gaagacctggagttcacagacatgggtggcaatgtgtacatcctcacgggcaaggtggag 1559
             ||||||||||||||||||||||||||||||||||||||||||||||||||||||||||||
V.14:  6649 gaagacctggagttcacagacatgggtggcaatgtgtacatcctcacgggcaaggtggag 6708

V.1:   1560 gcagagtttgagctgctgactgtggaggaggccgagaaacggccagtggggaaggggcgg 1619
             ||||||||||||||||||||||||||||||||||||||||||||||||||||||||||||
V.14:  6649 gcagagtttgagctgctgactgtggaggaggccgagaaacggccagtggggaaggggcgg 6768

V.1:   1620 aagcagccagagcctctggagaaacccagccgccccaaaacttccttcaactggtttgtg 1679
             ||||||||||||||||||||||||||||||||||||||||||||||||||||||||||||
V.14:  6769 aagcagccagagcctctggagaaacccagccgccccaaaacttccttcaactggtttgtg 6828

V.1:   1680 aacccgctgaagacctttgtcttcttcatctggcgccggtactggcgcaccctggtgctg 1739
             ||||||||||||||||||||||||||||||||||||||||||||||||||||||||||||
V.14:  6829 aacccgctgaagacctttgtcttcttcatctggcgccggtactggcgcaccctggtgctg 6888

V.1:   1740 ctgctactggtgctgctcaccgtcttcctcctcctggtcttctacaccatccctggccag 1799
             ||||||||||||||||||||||||||||||||||||||||||||||||||||||||||||
V.14:  6889 ctgctactggtgctgctcaccgtcttcctcctcctggtcttctacaccatccctggccag 6948

V.1:   1800 atcagccaggtcatcttccgtcccctccacaagtgactctcgctgaccttggacactcac 1859
             ||||||||||||||||||||||||||||||||||||||||||||||||||||||||||||
V.14:  6949 atcagccaggtcatcttccgtcccctccacaagtgactctcgctgaccttggacactcac 7008

V.1:   1860 ccagggtgccaacccttcaatgcctgctcctggaagtctttcttacccatgtgagctacc 1919
             ||||||||||||||||||||||||||||||||||||||||||||||||||||||||||||
V.14:  7009 ccagggtgccaacccttcaatgcctgctcctggaagtctttcttacccatgtgagctacc 7068

V.1:   1920 ccagagtctagtcttcctctgaataaacctatcacagcc                      1959
             |||||||||||||||||||||||||||||||||||||||
V.14:  7069 ccagagtctagtcttcctctgaataaacctatcacagcc                      7108
```

TABLE LIV(b)

Peptide sequences of protein coded by 158P3D2 v.14

(SEQ ID NO: 345)

```
MALTVSVQRL TGLTGTHDRQ VKLTFRGFTQ KTRKIHCGPE ADIGELFRWP HYGAPLAGEC    60

LSVQVVNCSR VFSLRPLGTL VISLQQLQNA GHLVLREALV DENLQVSPIQ VELDLKYQPP   120
```

TABLE LIV(b)-continued

Peptide sequences of protein coded by 158P3D2 v.14

```
EGATGAWSEE DFGAPIQDSF ELIIPNVGFQ ELEPGEAQLE RRAVALGRRL ARSLGQQDDE   180
ENELELELEQ DLDDEPDVEL SGVMFSPLKS RARALAHGDP FQVSRAQDFQ VGVTVLEAQK   240
LVGVNINPYV AVQVGGQRRV TATQRGTSCP FYNEYFLFEF HDTRLRLQDL LLEITVSGVG   300
VTSVLQRRGD EKAAGLTPPS PKAFHSQTLP FMATRIGTFR MDLGIILDQP DGQFYQRWVP   360
LHDPRDTRAG TKGFIKVTLS VRARGDLPPP MLPPAPGHCS DIEKNLLLPR GVPAERPWAR   420
LRVRLYRAEG LPALRLGLLG SLVRALHDQR VLVEPYVRVS FLGQEGETSV SAEAAAPEWN   480
EQLSFVELFP PLTRSLRLQL RDDAPLVDAA LATHVPDLRR ISHPGRAAGF NPTFGPAWVP   540
LYGSPPGAGL RDSLQGLNEG VGQGIWFRGR LLLAVSMQVL EGRAEPEPPQ AQQGSTLSRL   600
TRKKKKKARR DQTPKAVPQH LDASPGAEGP EIPRAMEVEV EELLPLPENV LAPCEDFLLF   660
GVLFEATMID PTVASQPISF EISIGRAGRL EEQLGRGSRA GEGTEGAAVE AQPLLGARPE   720
EEKEEEELGT HAQRPEPMDG SGPYFCLPLC HCKPCMHVWS CWEDHTWRLQ SSNCVRKVAE   780
RLDQGLQEVE RLQRKPGPGA CAQLKQALEV LVAGSRQFCH GAERRTMTRP NALDRCRGKL   840
LVHSLNLLAK QGLRLLRGLR RRNVQKKVAL AKKLLAKLRF LAEEPQPPLP DVLVWMLSGQ   900
RRVAWARIPA QDVLFSVVEE ERGRDCGKIQ SLMLTAPGAA PGEVCAKLEL FLRLGLGKQA   960
KACTSELPPD LLPEPSAGLP SSLHRDDFSY FQLRAHLYQA RGVLAADDSG LSDPFARVLI  1020
STQCQTTRVL EQTLSPLWDE LLVFEQLIVD GRREHLQEEP PLVIINVFDH NKFGPPVFLG  1080
RALAAPRVKL MEDPYQRPEL QFFPLRKGPW AAGELIAAFQ LIELDYSGRL EPSVPSEVEP  1140
QDLAPLVEPH SGRLSLPPNV CPVLREFRVE VLFWGLRGLG RVHLLEVEQP QVVLEVAGQG  1200
VESEVLASYR ESPNFTELVR HLTVDLPEQP YLQPPLSILV IERRAFGHTV LVGSHIVPHM  1260
LRFTFRGHED PPEEEGEMEE TGDMMPKGPQ GQKSLDPFLA EAGISRQLLK PPLKKLPLGG  1320
LLNQGPGLEE DIPDPEELDW GSKYYASLQE LQGQHNFDED EMDDPGDSDG VNLISMVGEI  1380
QDQDLQQVPE GRI                                                    1393
```

TABLE LV(b)

Amino acid sequence alignment of 121P1F1 v.1 and 158P3D2 v.14

No significant similarity

TABLE LIV(b)

Nucleotide sequence of transcript variant 158P3D2 v.14

(SEQ ID NO: 346)
```
caggtgggcg ggctggtggg cagaagggca gacgggcaga ggaagtgcca gtgccactgg    60
gaccatggct ctgacggtaa gcgtgcaacg actaacaggg ctgaccggca cccacgaccg   120
acaagtgaag ctcacctttc gaggctttac ccagaaaaca agaaaaattc actgtggtcc   180
agaagcagat atcggtgagc tgttccgatg gccccactat ggggctccac tggctgggga   240
gtgtctgtct gtgcaggtgg tcaactgcag ccgtgtattc agccttaggc tctagggac    300
cctggtgatc tccctgcagc agctacagaa tgctgggcat ttggtgctac gggaagccct   360
agtggatgag aatcttcaag tgtccccgat ccaggtggag cttgacctga agtaccagcc   420
cccagagggc gctactggag cctggtcaga ggaggacttt ggggcaccca tccaggacag   480
cttcgagtta atcatcccca atgtgggctt ccaggaactg agcctgggg aggcccagct   540
```

TABLE LIV(b)-continued

Nucleotide sequence of transcript variant 158P3D2 v.14

```
ggagcggcgg gcagtggctc taggccgcag gctagctcga agtctaggcc agcaggacga   600
tgaagagaat gagctggagc ttgagctgga gcaggacctg gatgatgagc ctgacgtgga   660
actttctggt gttatgttca gcccctcaa gagccgcgcc agggccctgg cccatgggga   720
tcccttccag gtgtccagag ctcaagactt ccaggtggga gtcactgtgc tggaagccca   780
gaaactggtg ggagtcaaca ttaaccccta tgtggccgtg caagtggggg ggcagcgccg   840
tgtgaccgcc acacagcgtg ggaccagttg cccttctac aatgagtact tcttgttcga   900
atttcatgac acgcggcttc gtctccaaga cttgctgctg gagatcacgg tgagtggggt   960
aggggtgacc agtgtccttc agagaagggg ggatgagaaa gctgcaggac taacaccacc   1020
ttcccccaag gctttccatt cgcagaccct cccctttatg gccacccgga taggcacctt   1080
caggatggac ctgggcatca tcttggacca gccagatggc cagttctacc aaagatgggt   1140
tccgctgcat gatccccgag acaccgcgc cgggaccaag ggtttcatta aggtcacctt   1200
gtccgtgagg gcgcgcgggg acctgccccc tccaatgcta cccccggccc cagggcactg   1260
ttcggacatc gagaagaacc tgctcctgcc gcgcggggtg cccgccgaga ggccatgggc   1320
gcggctccgc gtgcgcctgt accgcgccga ggggcttccc gcgctgcgcc tggggctgct   1380
gggcagcctg gtccgcgccc tgcacgacca gcgcgtcctg gtggagccct atgtgcgggt   1440
gtctttcctg gggcaggagg gcgagacgtc ggtgagcgcc gaggcggcgg cgcccgaatg   1500
gaacgagcag ctgagcttcg tggagctctt cccgccgctg acgcgcagcc tccgcctgca   1560
gctgcgggac gacgcgcccc tggtcgacgc ggcactcgct acgcacgtgc cggacctgag   1620
gcggatctcc catccgggcc gcgcggcggg gtttaaccct accttcggcc cggcctgggt   1680
gccctctat ggctcgcccc ccggcgcggg gctccgggat agtcttcaag gtctcaacga   1740
aggcgttggc caaggcattt ggttccgcgg ccgccttctg ctggctgtgt ccatgcaggt   1800
gttggaaggg agagctgaac ctgagcctcc ccaggcccag caggggtcca cgttgtcccg   1860
gctcacccga aagaagaaaa agaaagccag aagggatcag accccaaagg cggttccgca   1920
gcacttggac gccagccccg gtgccgaggg gcctgagatc ccccgtgcca tggaggtgga   1980
ggtggaggag ctgctgccgc tgccagagaa tgtcctggcg ccctgtgaag atttcctgct   2040
tttcggtgtg ctcttcgagg ccaccatgat cgaccccacc gtggcctccc agcccatcag   2100
cttcgagatc tccattggtc gcgcaggccg tctggaggag caattgggcc gagggtccag   2160
ggctggggag ggaactgagg gtgcagccgt ggaggctcag cctctgctgg gagccaggcc   2220
agaggaggag aaagaggagg aagaactggg gacccatgct cagcggcctg agcccatgga   2280
cggcagtggg ccatacttct gcttgcccct ctgtcactgc aagccatgca tgcatgtgtg   2340
gagttgctgg gaggaccaca cctgcgcct cagagcagc aactgcgtgc gcaaagtggc   2400
cgagaggctg accaggggc tgcaggaggt tgagagactg cagcgcaagc cggggcctgg   2460
cgcctgtgca cagctcaagc aggcactgga agtactggtg gctgggagca gacagttttg   2520
ccacggtgcc gagcgcagga cgatgacccg gcccaatgcc ctggatcgat gccgagggaa   2580
actcctggtg cacagcctga acctttggc taagcaagga ctgcgacttc tacgcggcct   2640
gagacggcgc aatgtgcaaa agaaggtggc actggccaag aagctcctgg caaaactgcg   2700
ctttctggct gaggagcaca actttgatga agatgaaatg gatgatcctg gagattcaga   2760
tggggtcaac ctcattttcta tggttgggga gatccaagac cagggtgagg ctgaagtcaa   2820
aggcactgtg tccccaaaaa aagcagttgc caccctgaag atctacaaca ggtccctgaa   2880
```

TABLE LIV(b)-continued

Nucleotide sequence of transcript variant 158P3D2 v.14

```
ggaagaattt aaccactttg aagactggct gaatgtgttt cctctgtacc gagggcaagg      2940
gggccaggat ggaggtggag aagaggaagg atctggacac cttgtgggca agttcaaggg      3000
ctccttcctc atttaccctg aatcagaggc agtgttgttc tctgagcccc agatctcccg      3060
ggggatccca cagaaccggc ccatcaagct cctggtcaga gtgtatgttg taaagctaag      3120 aaaccttttgc aaaatccaag gtcatgaaga cttttgcctg ttttctgctg ctaccaacct     3180
ggctcctgca gaccccaatg gcaaagcaga cccttacgtg gtggtgagcg ctggccggga      3240
gcggcaggac accaaggaac gctacatccc caagcagctc aaccccatct ttggagagat      3300
cctggagcta agcatctctc tcccagctga gacggagctg acggtcgccg tatttgatca      3360
tgacctcgtg ggttctgacg acctcatcgg ggagacccac attgatctgg aaaaccgatt      3420
ctatagccac cacagagcaa actgtgggct ggcctcccag tatgaagtgt gggtccagca      3480
gggcccacag gagccattct gagtttctgg ccaaacacat tcaagctcac attccctttt     3540
gtgtctccag atcctatgat ttcatggaag gggaccctcc cacccaccgc cactgccaac      3600
caagacatag ctcagtggtc aagacttggg cttgggagtc gggatcctgt aacgaatgtc      3660
acttgaccgc tttctttttt tatgaaacag tctcgctctg tctcccaggt tggagtgcag      3720
tggcacgatc tcggctgact gcaacctcca cctcctgggt tcaagcgatt ctcctgcctc      3780
agcctcccca gtagctggga ttacaggcgt gggcccccat gtccagctaa tttttatatt      3840
ttcgctctgt ctcccaggtt ggagtgcagt ggcacgatct cggctgactg caacctccac      3900
ctcctgggtt caagcgattc tcctgcctca gcctcccag tagctgggat tacaggcgtg      3960
ggcccccatg tccagctaat ttttatattt ttagtagaga cagggtttca ccatgttgtc      4020
caggctggtc ttgaacccct gacctcaagt gatccaccca cctctgcctc ccaaagtgct      4080
gggattacag gtgtgagcca ccatgccagg ccctcttaac ctcttcaagt ctgttttctc      4140
atctgcaaaa cagaggtaat aagatcagta tcttcttaat ggaagcacct ggactacatt      4200
tttttcattc attgttatca taaatgagga ctaacctgtc tcccgttggg agttttgaac      4260
ctagacctca tgtcttcatg acgtcatcac tgccccaggc ccagctgtgt ccctacacca      4320
gccccagctg acgcatcttc tttttctgcc tgtagagatg gttacaatgc ctggcgtgat      4380
gcattctggc cttcgcagat cctggcgggg ctgtgccaac gctgtggcct ccctgcccct      4440
gaataccgag ccggtgctgt caaggtgggc agcaaagtct tcctgacacc accggagacc      4500
ctgcccccag ggatctcttc acatgtggat tgacatcttt cctcaagatg tgcctgctcc      4560 accccccagtt gacatcaagc ctcggcagcc aatcagctat gagctcagag ttgtcatctg      4620
gaacacggag gatgtggttc tggatgacga gaatccactc accggagaga tgtcgagtga      4680
catctatgtg aagaggtagg ctgctggccg ggcggggcaa cggcggtgca ctagggggat      4740
tgcaaatggg tgtgggccct cgggctgagt ccagagcccc gaccccaggc cctccgtggt      4800
gctgagagcg gggtgaggag tgggttctcc atgtagctcc agccctgacg ctcacccacc      4860 ccggcccccag ctgggtgaag gggttggagc atgacaagca ggagacagac gttcacttca      4920
actccctgac tggggagggg aacttcaatt ggcgctttgt gttccgcttt gactacctgc      4980
ccacggagcg ggaggtgagc gtctggcgca ggtctggacc ctttgccctg gaggaggcgg      5040
agttccggca gcctgcagtg ctggtcctgc aggtctggga ctatgaccgc atctctgcca      5100
atgacttcct tggtattaca atgcttagcc ttccccaccc tcagcccctg cctccagccc      5160
tcacctccgc ccctgcctcc agccctcact tccgtccccc agttccctac tctgacccaa      5220
```

TABLE LIV(b)-continued

Nucleotide sequence of transcript variant 158P3D2 v.14

```
ccttgaatct tgggattttg gacccgaggt gtgaaacctt tgctttctgg cctaattact   5280
gagttaatta ggcctagacc acagtaacct ccattcccac ccagagtctc tgattcaact   5340
ctgatttgac cctagcttgt caccctgaca ccgactccac agcctttggt ccttggcact   5400
ctgatcccga cccttggccc tcttccactg ggaagtagca atgggtggac cgctgggctg   5460
tggtctgggt ggtctatagc tgtggcctga ccgcacactg caacaactttt caatgcccca   5520
atttacaacc ttggtgtgtt gcctcctcac ccctggcaca atgagacttt gatcccatgc   5580
ctaatctggt gtgctctgga cttgcaggat ccctggagtt gcagctacca gacatggtgc   5640
gtggggcccg ggccccgag ctctgctctg tgcagctggc ccgcaatggg gccgggccga   5700
ggtgcaatct gtttcgctgc cgccgcctga ggggctggtg gccggtagtg aagctgaagg   5760
aggcagagga cgtggagcgg gaggcgcagg aggctcaggc tggcaagaag aagcgaaagc   5820
agaggaggag gaagggccgg ccagaagacc tggagttcac agacatgggt ggcaatgtgt   5880
acatcctcac gggcaaggtg gaggcagagt ttgagctgct gactgtggag gaggccgaga   5940
aacggccagt ggggaagggg cggaagcagc cagagcctct ggagaaaccc agccgcccca   6000
aaacttcctt caactggttt gtgaacccgc tgaagacctt tgtcttcttc atctggcgcc   6060
ggtactggcg caccctggtg ctgctgctac tggtgctgct caccgtcttc ctcctcctgg   6120
tcttctacac catccctggc cagatcagcc aggtcatctt ccgtcccctc cacaagtgac   6180
tctcgctgac cttggacact cacccagggt gccaacccctt caatgcctgc tcctggaagt   6240
cttctcttacc catgtgagct accccagagt ctagtgcttc ctctgaataa acctatcaca   6300
gcc                                                                 6303
```

TABLE LIII(c)

Nucleotide sequence alignment of 121P1F1 v.1 (SEQ ID NO: 347) and 158P3D2 v.15 (SEQ ID NO: 348)

Score = 1963 bits (1021), Expect = 0.0 Identities = 1021/1021 (100%)
Strand = Plus/Plus

```
V.1:     1 tttttttatgaaacagtctcgctctgtctcccaggttggagtgcagtggcacgatctcgg   60
           ||||||||||||||||||||||||||||||||||||||||||||||||||||||||||||
V.15: 3675 tttttttatgaaacagtctcgctctgtctcccaggttggagtgcagtggcacgatctcgg 3734

V.1:    61 ctgactgcaacctccacctcctgggttcaagcgattctcctgcctcagcctccccagtag  120
           ||||||||||||||||||||||||||||||||||||||||||||||||||||||||||||
V.15: 3735 ctgactgcaacctccacctcctgggttcaagcgattctcctgcctcagcctccccagtag 3794

V.1:   121 ctgggattacaggcgtgggccccatgtccagctaattttttatattttcgctctgtctcc  180
           ||||||||||||||||||||||||||||||||||||||||||||||||||||||||||||
V.15: 3795 ctgggattacaggcgtgggccccatgtccagctaattttttatattttcgctctgtctcc 3854

V.1:   181 caggttggagtgcagtggcacgatctcggctgactgcaacctccacctcctgggttcaag  240
           ||||||||||||||||||||||||||||||||||||||||||||||||||||||||||||
V.15: 3855 caggttggagtgcagtggcacgatctcggctgactgcaacctccacctcctgggttcaag 3914

V.1:   241 cgattctcctgcctcagcctccccagtagctgggattacaggcgtgggcccccatgtcca  300
           ||||||||||||||||||||||||||||||||||||||||||||||||||||||||||||
V.15: 3915 cgattctcctgcctcagcctccccagtagctgggattacaggcgtgggcccccatgtcca 3974

V.1:   301 gctaattttttatattttttagtagagacagggtttcaccatgttgtccaggctggtcttga  360
           ||||||||||||||||||||||||||||||||||||||||||||||||||||||||||||
V.15: 3975 gctaattttttatattttttagtagagacagggtttcaccatgttgtccaggctggtcttga 4034
```

TABLE LIII(c)-continued

Nucleotide sequence alignment of 121P1F1 v.1 (SEQ
ID NO: 347) and 158P3D2 v.15 (SEQ ID NO: 348)

```
V.1:    361 acccctgacctcaagtgatccacccacctctgcctcccaaagtgctgggattacaggtgt  420
            ||||||||||||||||||||||||||||||||||||||||||||||||||||||||||||
V.15:  4035 acccctgacctcaagtgatccacccacctctgcctcccaaagtgctgggattacaggtgt 4094

V.1:    421 gagccaccatgccaggccctcttaacctcttcaagtctgttttctcatctgcaaaacaga  480
            ||||||||||||||||||||||||||||||||||||||||||||||||||||||||||||
V.15:  4095 gagccaccatgccaggccctcttaacctcttcaagtctgttttctcatctgcaaaacaga 4154

V.1:    481 ggtaataagatcagtatcttcttaatggaagcacctggactacattttttttcattcattg  540
            ||||||||||||||||||||||||||||||||||||||||||||||||||||||||||||
V.15:  4155 ggtaataagatcagtatcttcttaatggaagcacctggactacattttttttcattcattg 4214

V.1:    541 ttatcataaatgaggactaacctgtctcccgttgggagttttgaacctagacctcatgtc  600
            ||||||||||||||||||||||||||||||||||||||||||||||||||||||||||||
V.15:  4215 ttatcataaatgaggactaacctgtctcccgttgggagttttgaacctagacctcatgtc 4274

V.1:    601 ttcatgacgtcatcactgccccaggcccagctgtgtccctacaccagccccagctgacgc  660
            ||||||||||||||||||||||||||||||||||||||||||||||||||||||||||||
V.15:  4275 ttcatgacgtcatcactgccccaggcccagctgtgtccctacaccagccccagctgacgc 4334

V.1:    661 atcttcttttctgcctgtagagatggttacaatgcctggcgtgatgcattctggccttc  720
            ||||||||||||||||||||||||||||||||||||||||||||||||||||||||||||
V.15:  4335 atcttcttttctgcctgtagagatggttacaatgcctggcgtgatgcattctggccttc 4394

V.1:    721 gcagatcctggcggggctgtgccaacgctgtggcctccctgcccctgaataccgagccgg  780
            ||||||||||||||||||||||||||||||||||||||||||||||||||||||||||||
V.15:  4395 gcagatcctggcggggctgtgccaacgctgtggcctccctgcccctgaataccgagccgg 4454

V.1:    781 tgctgtcaaggtgggcagcaaagtcttcctgacaccaccggagaccctgcccccagggat  840
            ||||||||||||||||||||||||||||||||||||||||||||||||||||||||||||
V.15:  4455 tgctgtcaaggtgggcagcaaagtcttcctgacaccaccggagaccctgcccccagggat 4514

V.1:    841 ctcttcacatgtggattgacatctttcctcaagatgtgcctgctccacccccagttgaca  900
            ||||||||||||||||||||||||||||||||||||||||||||||||||||||||||||
V.15:  4515 ctcttcacatgtggattgacatctttcctcaagatgtgcctgctccacccccagttgaca 4574

V.1:    901 tcaagcctcggcagccaatcagctatgagctcagagttgtcatctggaacacggaggatg  960
            ||||||||||||||||||||||||||||||||||||||||||||||||||||||||||||
V.15:  4575 tcaagcctcggcagccaatcagctatgagctcagagttgtcatctggaacacggaggatg 4634

V.1:    961 tggttctggatgacgagaatccactcaccggagagatgtcgagtgacatctatgtgaaga 1020
            ||||||||||||||||||||||||||||||||||||||||||||||||||||||||||||
V.15:  4635 tggttctggatgacgagaatccactcaccggagagatgtcgagtgacatctatgtgaaga 4694

V.1:   1021 g                                                            1021
            |
V.15:  4695 g                                                            4695

Score = 1340 bits (697), Expect = 0.0 Identities = 697/697 (100%)
Strand = Plus/Plus V.1:   1263 ggatccctggagttgcagctaccagacatggtgcgtggggcccggggccccgagctctgc 1322
            ||||||||||||||||||||||||||||||||||||||||||||||||||||||||||||
V.15:  5607 ggatccctggagttgcagctaccagacatggtgcgtggggcccggggccccgagctctgc 5666

V.1:   1323 tctgtgcagctggcccgcaatggggccgggccgaggtgcaatctgtttcgctgccgccgc 1382
            ||||||||||||||||||||||||||||||||||||||||||||||||||||||||||||
V.15:  5667 tcaagcctcggcagccaatcagctatgagctcagagttgtcatctggaacacggaggatg 5726

V.1:   1383 ctgaggggctggtggccggtagtgaagctgaaggaggcagaggacgtggagcgggaggcg 1442
            ||||||||||||||||||||||||||||||||||||||||||||||||||||||||||||
V.15:  5727 ctgaggggctggtggccggtagtgaagctgaaggaggcagaggacgtggagcgggaggcg 5786
```

TABLE LIII(c)-continued

Nucleotide sequence alignment of 121P1F1 v.1 (SEQ ID NO: 347) and 158P3D2 v.15 (SEQ ID NO: 348)

```
V.1:   1443 caggaggctcaggctggcaagaagaagcgaaagcagaggaggaggaagggccggccagaa 1502
            ||||||||||||||||||||||||||||||||||||||||||||||||||||||||||||
V.15:  5787 caggaggctcaggctggcaagaagaagcgaaagcagaggaggaggaagggccggccagaa 5846

V.1:   1503 gacctggagttcacagacatgggtggcaatgtgtacatcctcacgggcaaggtggaggca 1562
            ||||||||||||||||||||||||||||||||||||||||||||||||||||||||||||
V.15:  5847 gacctggagttcacagacatgggtggcaatgtgtacatcctcacgggcaaggtggaggca 5906

V.1:   1563 gagtttgagctgctgactgtggaggaggccgagaaacggccagtggggaaggggcggaag 1622
            ||||||||||||||||||||||||||||||||||||||||||||||||||||||||||||
V.15:  5907 gagtttgagctgctgactgtggaggaggccgagaaacggccagtggggaaggggcggaag 5966

V.1:   1623 cagccagagcctctggagaaacccagccgccccaaaacttccttcaactggtttgtgaac 1682
            ||||||||||||||||||||||||||||||||||||||||||||||||||||||||||||
V.15:  5967 cagccagagcctctggagaaacccagccgccccaaaacttccttcaactggtttgtgaac 6026

V.1:   1683 ccgctgaagacctttgtcttcttcatctggcgccggtactggcgcaccctggtgctgctg 1742
            ||||||||||||||||||||||||||||||||||||||||||||||||||||||||||||
V.15:  6027 ccgctgaagacctttgtcttcttcatctggcgccggtactggcgcaccctggtgctgctg 6086

V.1:   1743 ctactggtgctgctcaccgtcttcctcctcctggtcttctacaccatccctggccagatc 1802
            ||||||||||||||||||||||||||||||||||||||||||||||||||||||||||||
V.15:  6087 ctactggtgctgctcaccgtcttcctcctcctggtcttctacaccatccctggccagatc 6146

V.1:   1803 agccaggtcatcttccgtcccctccacaagtgactctcgctgaccttggacactcaccca 1862
            ||||||||||||||||||||||||||||||||||||||||||||||||||||||||||||
V.15:  6147 agccaggtcatcttccgtcccctccacaagtgactctcgctgaccttggacactcaccca 6206

V.1:   1863 gggtgccaacccttcaatgcctgctcctggaagtctttcttacccatgtgagctacccca 1922
            ||||||||||||||||||||||||||||||||||||||||||||||||||||||||||||
V.15:  6207 gggtgccaacccttcaatgcctgctcctggaagtctttcttacccatgtgagctacccca 6266

V.1:   1923 gagtctagtgcttcctctgaataaacctatcacagcc                        1959
            |||||||||||||||||||||||||||||||||||||
V.15:  6267 gagtctagtgcttcctctgaataaacctatcacagcc                        6303

Score = 471 bits (245), Expect = e-129 Identities = 245/245 (100%)
Strand = Plus/Plus V.1:   1020 agctgggtgaaggggttggagcatgacaagcaggagacagacgttcacttcaactccctg 1079
            ||||||||||||||||||||||||||||||||||||||||||||||||||||||||||||
V.15:  4869 agctgggtgaaggggttggagcatgacaagcaggagacagacgttcacttcaactccctg 4928

V.1:   1080 actggggaggggaacttcaattggcgctttgtgttccgctttgactacctgcccacggag 1139
            ||||||||||||||||||||||||||||||||||||||||||||||||||||||||||||
V.15:  4929 actggggaggggaacttcaattggcgctttgtgttccgctttgactacctgcccacggag 4988

V.1:   1140 cgggaggtgagcgtctggcgcaggtctggaccctttgccctggaggaggcggagttccgg 1199
            ||||||||||||||||||||||||||||||||||||||||||||||||||||||||||||
V.15:  4989 cgggaggtgagcgtctggcgcaggtctggaccctttgccctggaggaggcggagttccgg 5048

V.1:   1200 cagcctgcagtgctggtcctgcaggtctgggactatgaccgcatctctgccaatgacttc 1259
            ||||||||||||||||||||||||||||||||||||||||||||||||||||||||||||
V.15:  5049 cagcctgcagtgctggtcctgcaggtctgggactatgaccgcatctctgccaatgacttc 5108

V.1:   1260 cttgg                                                        1264
            |||||
V.15:  5109 cttgg                                                        5113
```

TABLE LIV(c)

Peptide sequences of protein coded by 158P3D2 v.15

(SEQ ID NO: 349)

```
MALTVSVQRL TGLTGTHDRQ VKLTFRGFTQ KTRKIHCGPE ADIGELFRWP HYGAPLAGEC    60
LSVQVVNCSR VFSLRPLGTL VISLQQLQNA GHLVLREALV DENLQVSPIQ VELDLKYQPP   120
EGATGAWSEE DFGAPIQDSF ELIIPNVGFQ ELEPGEAQLE RRAVALGRRL ARSLGQQDDE   180
ENELELELEQ DLDDEPDVEL SGVMFSPLKS RARALAHGDP FQVSRAQDFQ VGVTVLEAQK   240
LVGVNINPYV AVQVGGQRRV TATQRGTSCP FYNEYFLFEF HDTRLRLQDL LLEITVSGVG   300
VTSVLQRRGD EKAAGLTPPS PKAFHSQTLP FMATRIGTFR MDLGIILDQP DGQFYQRWVP   360
LHDPRDTRAG TKGFIKVTLS VRARGDLPPP MLPPAPGHCS DIEKNLLLPR GVPAERPWAR   420
LRVRLYRAEG LPALRLGLLG SLVRALHDQR VLVEPYVRVS FLGQEGETSV SAEAAAPEWN   480
EQLSFVELFP PLTRSLRLQL RDDAPLVDAA LATHVPDLRR ISHPGRAAGF NPTFGPAWVP   540
LYGSPPGAGL RDSLQGLNEG VGQGIWFRGR LLLAVSMQVL EGRAEPEPPQ AQQGSTLSRL   600
TRKKKKARR DQTPKAVPQH LDASPGAEGP EIPRAMEVEV EELLPLPENV LAPCEDFLLF    660
GVLFEATMID PTVASQPISF EISIGRAGRL EEQLGRGSRA GEGTEGAAVE AQPLLGARPE   720
EEKEEEELGT HAQRPEPMDG SGPYFCLPLC HCKPCMHVWS CWEDHTWRLQ SSNCVRKVAE   780
RLDQGLQEVE RLQRKPGPGA CAQLKQALEV LVAGSRQFCH GAERRTMTRP NALDRCRGKL   840
LVHSLNLLAK QGLRLLRGLR RRNVQKKVAL AKKLLAKLRF LAEEHNFDED EMDDPGDSDG   900
VNLISMVGEI QDQGEAEVKG TVSPKKAVAT LKIYNRSLKE EFNHFEDWLN VFPLYRGQGG   960
QDGGGEEEGS GHLVGKFKGS FLIYPESEAV LFSEPQISRG IPQNRPIKLL VRVYVVKLRN  1020
LCKIQGHEDF CLFSAATNLA PADPNGKADP YVVVSAGRER QDTKERYIPK QLNPIFGEIL  1080
ELSISLPAET ELTVAVFDHD LVGSDDLIGE THIDLENRFY SHHRANCGLA SQYEVWVQQG  1140
PQEPF                                                              1145
```

TABLE LV(c)

Amino acid sequence alignment of 121P1F1 v.1 and 158P3D2 v.15

40

No significant similarity

TABLE LII(d)

Nucleotide sequence of transcript variant 158P3D2 v.16

(SEQ ID NO: 350)

```
caggtgggcg ggctggtggg cagaagggca gacgggcaga ggaagtgcca gtgccactgg    60
gaccatggct ctgacggtaa gcgtgcaacg actaacaggg ctgaccggca cccacgaccg   120
acaagtgaag ctcacctttc gaggctttac ccagaaaaca agaaaaattc actgtggtcc   180
agaagcagat atcggtgagc tgttccgatg gcccactat ggggctccac tggctgggga    240
gtgtctgtct gtgcaggtgg tcaactgcag ccgtgtattc agccttaggc ctctagggac   300
cctggtgatc tccctgcagc agctacagaa tgctgggcat tggtgctac gggaagccct    360
agtggatgag aatcttcaag tgtccccgat ccaggtggag cttgacctga agtaccagcc   420
cccagagggc gctactggag cctggtcaga ggaggacttt ggggcaccca tccaggacag   480
cttcgagtta atcatcccca atgtgggctt ccaggaactg gagcctgggg aggcccagct   540
ggagcggcgg gcagtggctc taggccgcag gctagctcga agtctaggcc agcaggacga   600
```

TABLE LII(d)-continued

Nucleotide sequence of transcript variant 158P3D2 v.16

```
tgaagagaat gagctggagc ttgagctgga gcaggacctg gatgatgagc ctgacgtgga     660
actttctggt gttatgttca gcccctcaa gagccgcgcc agggccctgg cccatgggga      720
tcccttccag gtgtccagag ctcaagactt ccaggtggga gtcactgtgc tggaagccca    780
gaaactggtg ggagtcaaca ttaacccta tgtggccgtg caagtggggg ggcagcgccg     840
tgtgaccgcc acacagcgtg ggaccagttg ccccttctac aatgagtact tcttgttcga    900
atttcatgac acgcggcttc gtctccaaga cttgctgctg gagatcacgg tgagtggggt    960
agggggtgacc agtgtccttc agagaagggg ggatgagaaa gctgcaggac taacaccacc   1020
ttcccccaag gctttccatt cgcagaccct ccccttatg gccacccgga taggcacctt     1080
caggatggac ctgggcatca tcttggacca gccagatggc cagttctacc aaagatgggt    1140
tccgctgcat gatccccgag acacccgcgc cgggaccaag ggtttcatta aggtcacctt    1200
gtccgtgagg gcgcgcgggg acctgccccc tccaatgcta ccccggccc cagggcactg     1260
ttcggacatc gagaagaacc tgctcctgcc gcgcggggtg cccgccgaga ggccatgggc    1320
gcggctccgc gtgcgcctgt accgcgccga ggggcttccc gcgctgcgcc tggggctgct    1380
gggcagcctg gtccgcgccc tgcacgacca gcgcgtcctg gtggagccct atgtgcgggt    1440
gtctttcctg gggcaggagg gcgagacgtc ggtgagcgcc gaggcggcgg cgcccgaatg    1500
gaacgagcag ctgagcttcg tggagctctt cccgccgctg acgcgcagcc tccgcctgca    1560
gctgcgggac gacgcgcccc tggtcgacgc ggcactcgct acgcacgtgc cggacctgag    1620
gcggatctcc catccgggcc gcgcggcggg gtttaaccct accttcggcc cggcctgggt    1680
gccctctat ggctcgcccc ccggcgcggg gctccgggat agtcttcaag gtctcaacga     1740
aggcgttggc caaggcattt ggttccgcgg ccgccttctg ctggctgtgt ccatgcaggt    1800
gttggaaggg agagctgaac ctgagcctcc ccaggcccag caggggtcca cgttgtcccg    1860
gctcacccga aagaagaaaa agaaagccag aagggatcag accccaaagg cggttccgca    1920
gcacttggac gccagccccg gtgccgaggg gcctgagatc ccccgtgcca tggaggtgga    1980
ggtggaggag ctgctgccgc tgccagagaa tgtcctggcg ccctgtgaag atttcctgct    2040
tttcggtgtg ctcttcgagg ccaccatgat cgaccccacc gtggcctccc agcccatcag    2100
cttcgagatc tccattggtc gcgcaggccg tctggaggag caattgggcc gagggtccag    2160
ggctggggag ggaactgagg gtgcagccgt ggaggctcag cctctgctgg gagccaggcc    2220
agaggaggag aaagaggagg aagaactggg gacccatgct cagcggcctg agcccatgga    2280
cggcagtggg ccatacttct gcttgcccct ctgtcactgc aagccatgca tgcatgtgtg    2340
gagttgctgg gaggaccaca cctggcgcct gcagagcagc aactgcgtgc gcaaagtggc    2400
cgagaggctg gaccaggggc tgcaggaggt tgagagactg cagcgcaagc cggggcctgg    2460
cgcctgtgca cagctcaagc aggcactgga agtactggtg gctgggagca gacagttttg    2520
ccacggtgcc gagcgcagga cgatgacccg gcccaatgcc ctggatcgat gccgagggaa    2580
actcctggtg cacagcctga accttttggc taagcaagga ctgcgacttc tacgcggcct    2640
gagacggcgc aatgtgcaaa agaaggtggc actggccaag aagctcctgg caaaactgcg    2700
ctttctggct gaggagcccc agccacccct ccccgatgtg ctggtctgga tgctcagcgg    2760
gcagcgccgt gtggcctggg cccggatccc tgcccaggat gtgctgttct ctgtggttga    2820
ggaggaacgg ggccgagact gtgggaagat ccagagtcta atgctcacgg cacccggggc    2880
agcccctggt gaggtctgtg ccaagctgga gctcttcctg cggctgggcc tgggcaagca    2940
```

TABLE LII(d)-continued

Nucleotide sequence of transcript variant 158P3D2 v.16

```
agccaaggcc tgcacctctg agctgccccc ggatttgctg cccgagccct cagccgggct   3000
gccctccagc ctacaccggg acgactttag ctacttccaa ctccgggctc acttgtacca   3060
ggcccggggt gtgttggctg cagatgacag tggcctctcg accccttttg ctcgagtcct   3120
catctctacc cagtgtcaga ccacacgggt cctggagcag acgctgagcc ctctgtggga   3180
tgaactcctg gtatttgagc agttgatcgt ggatgggagg agggagcacc tgcaggagga   3240
gcctccatta gtgatcatca atgtatttga ccacaataag tttggccccc ccgtgttcct   3300
gggcagggca ctggccgccc caagggtaaa gctgatggag gacccatacc aacgcccaga   3360
gttgcagttc ttcccccctga ggaagggacc ctgggcagcc ggagagctca ttgccgcctt   3420
tcaactcatt gaactagact acagtggccg acttgagccc tcagtgccca gtgaggtgga   3480
gccccaggat ctggcacccc tggttgagcc ccactctgga cgcctgtccc ttccacccaa   3540
cgtgtgccca gtgctcaggg agttccgtgt tgaggtgctg ttctggggtc ttaggggact   3600
tggtcgtgtg catctgctcg aggtggagca gccccaggtt gtactggagg tggctgggca   3660
aggtgtggag tctgaggtcc tggccagcta ccgtgagagc cccaatttca ctgagcttgt   3720
caggcatctg acagtggtct tcaaagacac agctcctctc ttccacccccc aggacttgcc   3780
ggagcagcct tacttgcagc ctccactcag catcttggtg attgagcgcc gggcctttgg   3840
ccacacagtc cttgtgggtt cccacattgt ccccccacatg ctgcgattca catttcgggg   3900
tcatgaggat cctcctgagg aggaaggaga gatggaggag acaggggata tgatgcccaa   3960
gggacctcaa ggacagaagt ccctggatcc cttcttggct gaagcgggta tatccagaca   4020
gctcctgaag cctcctctga agaagctccc actaggaggc ctcctaaatc aaggccctgg   4080
gctggaggaa gacatcccag atccagagga gctcgactgg gggtccaagt actatgcgtc   4140
gctgcaggag ctccaggggc agcacaactt tgatgaagat gaaatggatg atcctggaga   4200
ttcagatggg gtcaacctca tttctatggt tgggagatc caagaccagg gtgaggctga   4260
agtcaaaggc actgtgtccc caaaaaaagc agttgccacc ctgaagatct acaacaggtc   4320
cctgaaggaa gaatttaacc actttgaaga ctggctgaat gtgtttcctc tgtaccgagg   4380
gcaaggggc caggatggag gtggagaaga ggaaggatct ggacaccttg tgggcaagtt   4440
caagggctcc ttcctcattt accctgaatc agaggcagtg ttgttctctg agccccagat   4500
ctcccggggg atcccacaga accggcccat caagctcctg gtcagagtgt atgttgtaaa   4560
ggctaccaac ctggctcctg cagacccaa tggcaaagca gacccttacg tggtggtgag   4620
cgctggccgg gagcggcagg acaccaagga acgctacatc cccaagcagc tcaaccccat   4680
ctttggagag atcctggagc taagcatctc tctcccagct gagacggagc tgacggtcgc   4740
cgtatttgat catgacctcg tgggttctga cgacctcatc ggggagaccc acattgatct   4800
ggaaaaccga ttctatagcc accacagagc aaactgtggg ctggcctccc agtatgaagt   4860
agatggttac aatgcctggc gtgatgcatt ctggccttcg cagatcctgg cggggctgtg   4920
ccaacgctgt ggcctccctg cccctgaata ccgagccggt gctgtcaagg tgggcagcaa   4980
agtcttcctg acaccaccgg agaccctgcc cccagtggcg agcggggacc ctgaagaggc   5040
ccaggcattg cttgtgctgc ggcgctggca ggaaatgccg ggttttggga tccagctggt   5100
acccgagcat gtagaaacca ggcctctcta ccatccccac agcccagggc tgctacaggg   5160
atctcttcac atgtggattg acatctttcc tcaagatgtg cctgctccac ccccagttga   5220
catcaagcct cggcagccaa tcagctatga gctcagagtt gtcatctgga acacggagga   5280
```

TABLE LII(d)-continued

Nucleotide sequence of transcript variant 158P3D2 v.16

```
tgtggttctg gatgacgaga atccactcac cggagagatg tcgagtgaca tctatgtgaa  5340
gagctgggtg aaggggttgg agcatgacaa gcaggagaca gacgttcact tcaactccct  5400
gactggggag gggaacttca attggcgctt tgtgttccgc tttgactacc tgcccacgga  5460
gcgggaggtg agcgtctggc gcaggtctgg accctttgcc ctggaggagg cggagttccg  5520
gcagcctgca gtgctggtcc tgcaggtctg ggactatgac cgcatctctg ccaatgactt  5580
ccttggatcc ctggagttgc agctaccaga catggtgcgt ggggcccggg gccccgagct  5640
ctgctctgtg cagctggccc gcaatggggc cgggccgagg tgcaatctgt ttcgctgccg  5700
ccgcctgagg ggctggtggc cggtagtgaa gctgaaggag gcagaggacg gcaaggtgga  5760
ggcagagttt gagctgctga ctgtggagga ggccgagaaa cggccagtgg ggaaggggcg  5820
gaagcagcca gagcctctgg agaaacccag ccgccccaaa acttccttca actggtttgt  5880
gaacccgctg aagacctttg tcttcttcat ctggcgccgg tactggcgca ccctggtgct  5940
gctgctactg gtgctgctca ccgtcttcct cctcctggtc ttctacacca tccctggcca  6000
gatcagccag gtcatcttcc gtcccctcca caagtgactc tcgctgacct tggacactca  6060
cccagggtgc caaccttca atgcctgctc ctggaagtct ttcttaccca tgtgagctac  6120
cccagagtcta gtgcttcct ctgaataaacctatcacagc c                       6161
```

TABLE LIII(d)

Nucleotide sequence alignment of 121P1F1 v.1 (SEQ
ID NO: 351) and 158P3D2 v.16 (SEQ ID NO: 352)

```
Score = 1144 bits (595), Expect = 0.0 Identities = 595/595 (100%)
Strand = Plus/Plus V.1:     834 cagggatctcttcacatgtggattgacatctttcctcaagatgtgcctgctccacccccca  893
             ||||||||||||||||||||||||||||||||||||||||||||||||||||||||||||
V.16:   5156 cagggatctcttcacatgtggattgacatctttcctcaagatgtgcctgctccacccccca 5215

V.1:     894 gttgacatcaagcctcggcagccaatcagctatgagctcagagttgtcatctggaacacg  953
             ||||||||||||||||||||||||||||||||||||||||||||||||||||||||||||
V.16:   5216 gttgacatcaagcctcggcagccaatcagctatgagctcagagttgtcatctggaacacg 5275

V.1:     954 gaggatgtggttctggatgacgagaatccactcaccggagagatgtcgagtgacatctat 1013
             ||||||||||||||||||||||||||||||||||||||||||||||||||||||||||||
V.16:   5276 gaggatgtggttctggatgacgagaatccactcaccggagagatgtcgagtgacatctat 5335

V.1:    1014 gtgaagagctgggtgaaggggttggagcatgacaagcaggagacagacgttcacttcaac 1073
             ||||||||||||||||||||||||||||||||||||||||||||||||||||||||||||
V.16:   5336 gtgaagagctgggtgaaggggttggagcatgacaagcaggagacagacgttcacttcaac 5395

V.1:    1074 tccctgactggggaggggaacttcaattggcgctttgtgttccgctttgactacctgccc 1133
             ||||||||||||||||||||||||||||||||||||||||||||||||||||||||||||
V.16:   5396 tccctgactggggaggggaacttcaattggcgctttgtgttccgctttgactacctgccc 5455

V.1:    1134 acggagcgggaggtgagcgtctggcgcaggtctggaccctttgccctggaggaggcggag 1193
             ||||||||||||||||||||||||||||||||||||||||||||||||||||||||||||
V.16:   5456 acggagcgggaggtgagcgtctggcgcaggtctggaccctttgccctggaggaggcggag 5515

V.1:    1943 ttccggcagcctgcagtgctggtcctgcaggtctgggactatgaccgcatctctgccaat 1253
             ||||||||||||||||||||||||||||||||||||||||||||||||||||||||||||
V.16:   5516 ttccggcagcctgcagtgctggtcctgcaggtctgggactatgaccgcatctctgccaat 5575
```

TABLE LIII(d)-continued

Nucleotide sequence alignment of 121P1F1 v.1 (SEQ ID NO: 351) and 158P3D2 v.16 (SEQ ID NO: 352)

```
V.1:   1254 gacttccttggatccctggagttgcagctaccagacatggtgcgtggggcccggggcccc 1313
             ||||||||||||||||||||||||||||||||||||||||||||||||||||||||||||
V.16:  5576 gacttccttggatccctggagttgcagctaccagacatggtgcgtggggcccggggcccc 5635

V.1:   1314 gagctctgctctgtgcagctggcccgcaatggggccgggccgaggtgcaatctgtttcgc 1373
             ||||||||||||||||||||||||||||||||||||||||||||||||||||||||||||
V.16:  5636 gagctctgctctgtgcagctggcccgcaatggggccgggccgaggtgcaatctgtttcgc 5695

V.1:   1374 tgccgccgcctgaggggctggtggccggtagtgaagctgaaggaggcagaggacg      1428
             ||||||||||||||||||||||||||||||||||||||||||||||||||||||
V.16:  5696 tgccgccgcctgaggggctggtggccggtagtgaagctgaaggaggcagaggacg      5750
```

Score = 792 bits (425), Expect = 0.0 Identities = 412/412 (100%)
Strand = Plus/Plus

```
V.1:   1548 ggcaaggtggaggcagagtttgagctgctgactgtggaggaggccgagaaacggccagtg 1607
             ||||||||||||||||||||||||||||||||||||||||||||||||||||||||||||
V.16:  5750 ggcaaggtggaggcagagtttgagctgctgactgtggaggaggccgagaaacggccagtg 5809

V.1:   1608 gggaaggggcggaagcagccagagcctctggagaaacccagccgcccaaaacttccttc 1667
             ||||||||||||||||||||||||||||||||||||||||||||||||||||||||||||
V.16:  5810 gggaaggggcggaagcagccagagcctctggagaaacccagccgcccaaaacttccttc 5869

V.1:   1668 aactggtttgtgaacccgctgaagacctttgtcttcttcatctggcgccggtactggcgc 1727
             ||||||||||||||||||||||||||||||||||||||||||||||||||||||||||||
V.16:  5870 aactggtttgtgaacccgctgaagacctttgtcttcttcatctggcgccggtactggcgc 5929

V.1:   1728 accctggtgctgctgctactggtgctgctcaccgtcttcctcctcctggtcttctacacc 1787
             ||||||||||||||||||||||||||||||||||||||||||||||||||||||||||||
V.16:  5930 accctggtgctgctgctactggtgctgctcaccgtcttcctcctcctggtcttctacacc 5989 v.1:   1788 atccctggccagatcagccaggtcatcttccgtcccctccacaagtgactctcgctgacc 1847
             ||||||||||||||||||||||||||||||||||||||||||||||||||||||||||||
V.16:  5990 atccctggccagatcagccaggtcatcttccgtcccctccacaagtgactctcgctgacc 6049

V.1:   1848 ttggacactcacccagggtgccaaccccttcaatgcctgctcctggaagtctttcttaccc 1907
             ||||||||||||||||||||||||||||||||||||||||||||||||||||||||||||
V.16:  6050 ttggacactcacccagggtgccaaccccttcaatgcctgctcctggaagtctttcttaccc 6109

V.1:   1908 atgtgagctaccccagagtctagtgcttcctctgaataaacctatcacagcc          1959
             |||||||||||||||||||||||||||||||||||||||||||||||||||||
V.16:  6110 atgtgagctaccccagagtctagtgcttcctctgaataaacctatcacagcc          6161
```

Score = 298 bits (155), Expect = 3e-77 Identities = 155/155 (100%)
Strand = Plus/Plus

```
V.1:    682 agatggttacaatgcctggcgtgatgcattctggccttcgcagatcctggcggggctgtg  741
             ||||||||||||||||||||||||||||||||||||||||||||||||||||||||||||
V.16:  4861 agatggttacaatgcctggcgtgatgcattctggccttcgcagatcctggcggggctgtg 4920

V.1:    742 ccaacgctgtggcctccctgcccctgaataccgagccggtgctgtcaaggtgggcagcaa  801
             ||||||||||||||||||||||||||||||||||||||||||||||||||||||||||||
V.16:  4921 ccaacgctgtggcctccctgcccctgaataccgagccggtgctgtcaaggtgggcagcaa 4980

V.1:    802 agtcttcctgacaccaccggagaccctgccccag                            836
             ||||||||||||||||||||||||||||||||||
V.16:  4981 agtcttcctgacaccaccggagaccctgccccag                           5015
```

TABLE LIV(d)

Peptide sequences of protein coded by 158P3D2 v.16

(SEQ ID NO: 353)

| | | | | | |
|---|---|---|---|---|---|
| MALTVSVQRL | TGLTGTHDRQ | VKLTFRGFTQ | KTRKIHCGPE | ADIGELFRWP | HYGAPLAGEC | 60 |
| LSVQVVNCSR | VFSLRPLGTL | VISLQQLQNA | GHLVLREALV | DENLQVSPIQ | VELDLKYQPP | 120 |
| EGATGAWSEE | DFGAPIQDSF | ELIIPNVGFQ | ELEPGEAQLE | RRAVALGRRL | ARSLGQQDDE | 180 |
| ENELELELEQ | DLDDEPDVEL | SGVMFSPLKS | RARALAHGDP | FQVSRAQDFQ | VGVTVLEAQK | 240 |
| LVGVNINPYV | AVQVGGQRRV | TATQRGTSCP | FYNEYFLFEF | HDTRLRLQDL | LLEITVSGVG | 300 |
| VTSVLQRRGD | EKAAGLTPPS | PKAFHSQTLP | FMATRIGTFR | MDLGIILDQP | DGQFYQRWVP | 360 |
| LHDPRDTRAG | TKGFIKVTLS | VRARGDLPPP | MLPPAPGHCS | DIEKNLLLPR | GVPAERPWAR | 420 |
| LRVRLYRAEG | LPALRLGLLG | SLVRALHDQR | VLVEPYVRVS | FLGQEGETSV | SAEAAAPEWN | 480 |
| EQLSFVELFP | PLTRSLRLQL | RDDAPLVDAA | LATHVPDLRR | ISHPGRAAGF | NPTFGPAWVP | 540 |
| LYGSPPGAGL | RDSLQGLNEG | VGQGIWFRGR | LLLAVSMQVL | EGRAEPEPPQ | AQQGSTLSRL | 600 |
| TRKKKKARR | DQTPKAVPQH | LDASPGAEGP | EIPRAMEVEV | EELLPLPENV | LAPCEDFLLF | 660 |
| GVLFEATMID | PTVASQPISF | EISIGRAGRL | EEQLGRGSRA | GEGTEGAAVE | AQPLLGARPE | 720 |
| EEKEEEELGT | HAQRPEPMDG | SGPYFCLPLC | HCKPCMHVWS | CWEDHTWRLQ | SSNCVRKVAE | 780 |
| RLDQGLQEVE | RLQRKPGPGA | CAQLKQALEV | LVAGSRQFCH | GAERRTMTRP | NALDRCRGKL | 840 |
| LVHSLNLLAK | QGLRLLRGLR | RRNVQKKVAL | AKKLLAKLRF | LAEEPQPPLP | DVLVWMLSGQ | 900 |
| RRVAWARIPA | QDVLFSVVEE | ERGRDCGKIQ | SLMLTAPGAA | PGEVCAKLEL | FLRLGLGKQA | 960 |
| KACTSELPPD | LLPEPSAGLP | SSLHRDDFSY | FQLRAHLYQA | RGVLAADDSG | LSDPFARVLI | 1020 |
| STQCQTTRVL | EQTLSPLWDE | LLVFEQLIVD | GRREHLQEEP | PLVIINVFDH | NKFGPPVFLG | 1080 |
| RALAAPRVKL | MEDPYQRPEL | QFFPLRKGPW | AAGELIAAFQ | LIELDYSGRL | EPSVPSEVEP | 1140 |
| QDLAPLVEPH | SGRLSLPPNV | CPVLREFRVE | VLFWGLRGLG | RVHLLEVEQP | QVVLEVAGQG | 1200 |
| VESEVLASYR | ESPNFTELVR | HLTVVFKDTA | PLFHPQDLPE | QPYLQPPLSI | LVIERRAFGH | 1260 |
| TVLVGSHIVP | HMLRFTFRGH | EDPPEEEGEM | EETGDMMPKG | PQGQKSLDPF | LAEAGISRQL | 1320 |
| LKPPLKKLPL | GGLLNQGPGL | EEDIPDPEEL | DWGSKYYASL | QELQGQHNFD | EDEMDDPGDS | 1380 |
| DGVNLISMVG | EIQDQGEAEV | KGTVSPKKAV | ATLKIYNRSL | KEEFNHFEDW | LNVFPLYRGQ | 1440 |
| GGQDGGGEEE | GSGHLVGKFK | GSFLIYPESE | AVLFSEPQIS | RGIPQNRPIK | LLVRVYVVKA | 1500 |
| TNLAPADPNG | KADPYVVVSA | GRERQDTKER | YIPKQLNPIF | GEILELSISL | PAETELTVAV | 1560 |
| FDHDLVGSDD | LIGETHIDLE | NRFYSHHRAN | CGLASQYEVD | GYNAWRDAFW | PSQILAGLCQ | 1620 |
| RCGLPAPEYR | AGAVKVGSKV | FLTPPETLPP | VASGDPEEAQ | ALLVLRRWQE | MPGFGIQLVP | 1680 |
| EHVETRPLYH | PHSPGLLQGS | LHMWIDIFPQ | DVPAPPPVDI | KPRQPISYEL | RVVIWNTEDV | 1740 |
| VLDDENPLTG | EMSSDIYVKS | WVKGLEHDKQ | ETDVHFNSLT | GEGNFNWRFV | FRFDYLPTER | 1800 |
| EVSVWRRSGP | FALEEAEFRQ | PAVLVLQVWD | YDRISANDFL | GSLELQLPDM | VRGARGPELC | 1860 |
| SVQLARNGAG | PRCNLFRCRR | LRGWWPVVKL | KEAEDGKVEA | EFELLTVEEA | EKRPVGKGRK | 1920 |
| QPEPLEKPSR | PKTSFNWFVN | PLKTFVFFIW | RRYWRTLVLL | LLVLLTVFLL | LVFYTIPGQI | 1980 |
| SQVIFRPLHK | | | | | | 1990 |

TABLE LV(d)

Amino acid sequence alignment of 121P1F1 v.1
(SEQ ID NO: 354) and 158P3D2 v.16 (SEQ ID NO: 355)

Score = 580 bits (1496), Expect = e-164 Identities = 288/328
(87%), Positives = 288/328 (87%), Gaps = 40/328 (12%)

```
V.1:      1 MWIDIFPQDVPAPPPVDIKPRQPISYELRVVIWNTEDVVLDDENPLTGEMSSDIYVKSWV       60
            MWIDIFPQDVPAPPPVDIKPRQPISYELRVVIWNTEDVVLDDENPLTGEMSSDIYVKSWV
V.16:  1703 MWIDIFPQDVPAPPPVDIKPRQPISYELRVVIWNTEDVVLDDENPLTGEMSSDIYVKSWV     1762

V.1:     61 KGLEHDKQETDVHFNSLTGEGNFNWRFVFRFDYLPTEREVSWRRSGPFALEEAEFRQPA      120
            KGLEHDKQETDVHFNSLTGEGNFNWRFVFRFDYLPTEREVSWRRSGPFALEEAEFRQPA
V.16:  1763 KGLEHDKQETDVHFNSLTGEGNFNWRFVFRFDYLPTEREVSWRRSGPFALEEAEFRQPA     1822

V.1:    121 VLVLQVWDYDRISANDFLGSLELQLPDMVRGARGPELCSVQLARNGAGPRCNLFRCRRLR     180
            VLVLQVWDYDRISANDFLGSLELQLPDMVRGARGPELCSVQLARNGAGPRCNLFRCRRLR
V.16:  1823 VLVLQVWDYDRISANDFLGSLELQLPDMVRGARGPELCSVQLARNGAGPRCNLFRCRRLR    1882

V.1:    181 GWWPVVKLKEAEDVEREAQEAQAGKKKRKQRRRKGRPEDLEFTDMGGNVYILTGKVEAEF     240
            GWWPVVKLKEAED                                       GKVEAEF
V.16:  1883 GWWPVVKLKEAED----------------------------------------GKVEAEF    1902

V.1:    241 ELLTVEEAEKRPVGKGRKQPEPLEKPSRPKTSFNWFVNPLKTFVFFIWRRYWRTLVLLLL     300
            ELLTVEEAEKRPVGKGRKQPEPLEKPSRPKTSFNWFVNPLKTFVFFIWRRYWRTLVLLLL
V.16:  1903 ELLTVEEAEKRPVGKGRKQPEPLEKPSRPKTSFNWFVNPLKTFVFFIWRRYWRTLVLLLL    1962

V.1:    301 VLLTVFLLLVFYTIPGQISQVIFRPLHK                                   328
            VLLTVFLLLVFYTIPGQISQVIFRPLHK
V.16:  1963 VLLTVFLLLVFYTIPGQISQVIFRPLHK                                  1990
```

TABLE LII(e)

Nucleotide sequence of transcript variant 158P3D2 v.17

(SEQ ID NO: 356)

```
caggtgggcg ggctggtggg cagaagggca gacgggcaga ggaagtgcca gtgccactgg     60
gaccatggct ctgacggtaa gcgtgcaacg actaacaggg ctgaccggca cccacgaccg    120
acaagtgaag ctcacctttc gaggctttac ccagaaaaca agaaaaattc actgtggtcc    180
agaagcagat atcggtgagc tgttccgatg gccccactat ggggctccac tggctgggga    240
gtgtctgtct gtgcaggtgg tcaactgcag ccgtgtattc agccttaggc ctctagggac    300
cctggtgatc tccctgcagc agctacgaaa tgctgggcat ttggtgctac gggaagccct    360
agtggatgag aatcttcaag tgtccccgat ccaggtggag cttgacctga agtaccagcc    420
cccagagggc gctactggag cctggtcaga ggaggacttt ggggcaccca tccaggacag    480
cttcgagtta atcatcccca atgtgggctt ccaggaactg gagcctgggg aggcccagct    540
ggagcggcgg gcagtggctc taggccgcag gctagctcga agtctaggcc agcaggacga    600
tgaagagaat gagctggagc ttgagctgga gcaggacctg gatgatgagc ctgacgtgga    660
actttctggt gttatgttca gccccctcaa gagccgcgcc agggccctgg cccatgggga    720
tcccttccag gtgtccagag ctcaagactt ccaggtggga gtcactgtgc tggaagccca    780
gaaactggtg ggagtcaaca ttaaccccta tgtggccgtg caagtggggg ggcagcgccg    840
tgtgaccgcc acacagcgtg ggaccagttg ccccttctac aatgagtact cttgttcga    900
atttcatgac acgcggcttc gtctccaaga cttgctgctg gagatcacgg tgagtggggt    960
agggggtgacc agtgtccttc agagaagggg ggatgagaaa gctgcaggac taacaccacc   1020
ttcccccaag gctttccatt cgcagaccct ccccttatg gccacccgga taggcacctt    1080
caggatggac ctgggcatca tcttggacca gccagatggc cagttctacc aaagatgggt   1140
tccgctgcat gatccccgag acacccgcgc cggaccaag gtttcatta aggtcacctt    1200
gtccgtgagg gcgcgcgggg acctgccccc tccaatgcta ccccggccc cagggcactg   1260
ttcggacatc gagaagaacc tgctcctgcc gcgcggggtg cccgccgaga ggccatgggc   1320
```

TABLE LII(e)-continued

Nucleotide sequence of transcript variant 158P3D2 v.17

```
gcggctccgc gtgcgcctgt accgcgccga ggggcttccc gcgctgcgcc tggggctgct    1380
gggcagcctg gtccgcgccc tgcacgacca gcgcgtcctg gtggagccct atgtgcgggt    1440
gtctttcctg gggcaggagg gcgagacgtc ggtgagcgcc gaggcggcgg cgcccgaatg    1500
gaacgagcag ctgagcttcg tggagctctt cccgccgctg acgcgcagcc tccgcctgca    1560
gctgcgggac gacgcgcccc tggtcgacgc ggcactcgct acgcacgtgc cggacctgag    1620
gcggatctcc catccgggcc gcgcggcggg gtttaaccct accttcggcc cggcctgggt    1680
gccccctctat ggctcgcccc ccggcgcggg gctccgggat agtcttcaag gtctcaacga    1740
aggcgttggc caaggcattt ggttccgcgg ccgccttctg ctggctgtgt ccatgcaggt    1800
gttggaaggg agagctgaac ctgagcctcc ccaggcccag caggggtcca cgttgtcccg    1860
gctcacccga aagaagaaaa agaaagccag aagggatcag accccaaagg cggttccgca    1920
gcacttggac gccagccccg gtgccgaggg gcctgagatc ccccgtgcca tggaggtgga    1980
ggtggaggag ctgctgccgc tgccagagaa tgtcctggcg ccctgtgaag atttcctgct    2040
tttcggtgtg ctcttcgagg ccaccatgat cgacccacc gtggcctccc agcccatcag    2100
cttcgagatc tccattggtc gcgcaggccg tctggaggag caattgggcc gagggtccag    2160
ggctggggag ggaactgagg gtgcagccgt ggaggctcag cctctgctgg gagccaggcc    2220
agaggaggag aaagaggagg aagaactggg gacccatgct cagcggcctg agcccatgga    2280
cggcagtggg ccatacttct gcttgcccct ctgtcactgc aagccatgca tgcatgtgtg    2340
gagttgctgg gaggaccaca cctggcgcct gcagagcagc aactgcgtgc gcaaagtggc    2400
cgagaggctg gaccaggggc tgcaggaggt tgagagactg cagcgcaagc cggggcctgg    2460
cgcctgtgca cagctcaagc aggcactgga agtactggtg gctgggagca gacagttttg    2520
ccacggtgcc gagcgcagga cgatgacccg gcccaatgcc ctggatcgat gccgagggaa    2580
actcctggtg cacagcctga acctttttggc taagcaagga ctgcgacttc tacgcggcct    2640
gagacggcgc aatgtgcaaa agaaggtggc actggccaag aagctcctgg caaaactgcg    2700
ctttctggct gaggagcccc agccaccct ccccgatgtg ctggtctgga tgctcagcgg    2760
gcagcgccgt gtggcctggg cccggatccc tgcccaggat gtgctgttct ctgtggttga    2820
ggaggaacgg ggccgagact gtgggaagat ccagagtcta atgctcacgg cacccggggc    2880
agccctggt gaggtctgtg ccaagctgga gctcttcctg cggctgggcc tgggcaagca    2940
agccaaggcc tgcacctctg agctgccccc ggatttgctg cccgagccct cagccgggct    3000
gccctccagc ctacaccggg acgactttag ctacttccaa ctccgggctc acttgtacca    3060
ggcccggggt gtgttggctg cagatgacag tggcctctcg gacccctttg ctcgagtcct    3120
catctctacc cagtgtcaga ccacacgggt cctggagcag acgctgagcc ctctgtggga    3180
tgaactcctg gtatttgagc agttgatcgt ggatgggagg agggagcacc tgcaggagga    3240
gcctccatta gtgatcatca atgtatttga ccacaataag tttggccccc ccgtgttcct    3300
gggcagggca ctggccgccc caagggtaaa gctgatggag gacccatacc aacgcccaga    3360
gttgcagttc ttccccctga ggaagggacc ctgggcagcc ggagagctca ttgccgcctt    3420
tcaactcatt gaactagact acagtggccg acttgagccc tcagtgccca gtgaggtgga    3480
gccccaggat ctggcacccc tggttgagcc ccactctgga cgcctgtccc ttccacccaa    3540
cgtgtgccca gtgctcaggg agttccgtgt tgaggtgctg ttctggggtc ttaggggact    3600
tggtcgtgtg catctgctcg aggtggagca gccccaggtt gtactggagg tggctgggca    3660
```

TABLE LII(e)-continued

Nucleotide sequence of transcript variant 158P3D2 v.17

```
aggtgtggag tctgaggtcc tggccagcta ccgtgagagc cccaatttca ctgagcttgt   3720
caggcatctg acagtggtct tcaaagacac agctcctctc ttccacccccc aggacttgcc   3780
ggagcagcct tacttgcagc ctccactcag catcttggtg attgagcgcc gggcctttgg   3840
ccacacagtc cttgtgggtt cccacattgt cccccacatg ctgcgattca catttcgggg   3900
tcatgaggat cctcctgagg aggaaggaga gatggaggag acaggggata tgatgcccaa   3960
gggacctcaa ggacagaagt ccctggatcc cttcttggct gaagcgggta tatccagaca   4020
gctcctgaag cctcctctga agaagctccc actaggaggc ctcctaaatc aaggccctgg   4080
gctggaggaa gacatcccag atccagagga gctcgactgg gggtccaagt actatgcgtc   4140
gctgcaggag ctccaggggc agcacaactt tgatgaagat gaaatggatg atcctggaga   4200
ttcagatggg gtcaacctca tttctatggt tggggagatc caagaccagg gtgaggctga   4260
agtcaaaggc actgtgtccc caaaaaaagc agttgccacc ctgaagatct acaacaggtc   4320
cctgaaggaa gaatttaacc actttgaaga ctggctgaat gtgtttcctc tgtaccgagg   4380
gcaaggggc caggatggag gtggagaaga ggaaggatct ggacaccttg tgggcaagtt   4440
caagggctcc ttcctcattt accctgaatc agaggcagtg ttgttctctg agccccagat   4500
ctcccggggg atcccacaga accggccat caagctcctg gtcagagtgt atgttgtaaa   4560
ggctaccaac ctggctcctg cagaccccaa tggcaaagca gacccttacg tggtggtgag   4620
cgctggccgg gagcggcagg acaccaagga acgctacatc cccaagcagc tcaaccccat   4680
ctttggagag atcctggagc taagcatctc tctcccagct gagacggagc tgacggtcgc   4740
cgtatttgat catgacctcg tgggttctga cgacctcatc ggggagaccc acattgatct   4800
ggaaaaccga ttctatagcc accacagagc aaactgtggg ctggcctccc agtatgaagt   4860
agatggttac aatgcctggc gtgatgcatt ctggccttcg cagatcctgg cggggctgtg   4920
ccaacgctgt ggcctccctg cccctgaata ccgagccggt gctgtcaagg tgggcagcaa   4980
agtcttcctg acaccaccgg agaccctgcc cccaggcagc agcagcccca cagtggcgag   5040
cggggaccct gaagaggccc aggcattgct tgtgctgcgg cgctggcagg aaatgccggg   5100
ttttgggatc cagctggtac ccgagcatgt agaaaccagg cctctctacc atccccacag   5160
cccagggctg ctacagggat ctcttcacat gtggattgac atctttcctc aagatgtgcc   5220
tgctccaccc ccagttgaca tcaagcctcg gcagccaatc agctatgagc tcagagttgt   5280
catctggaac acggaggatg tggttctgga tgacgagaat ccactcaccg gagagatgtc   5340
gagtgacatc tatgtgaaga gctgggtgaa ggggttggag catgacaagc aggagacaga   5400
cgttcacttc aactccctga ctggggaggg gaacttcaat tggcgctttg tgttccgctt   5460
tgactacctg cccacggagc gggaggtgag cgtctggcgc aggtctggac cctttgccct   5520
ggaggaggcg gagttccggc agcctgcagt gctggtcctg caggtctggg actatgaccg   5580
catctctgcc aatgacttcc ttggatccct ggagttgcag ctaccagaca tggtgcgtgg   5640
ggcccggggc cccgagctct gctctgtgca gctggcccgc aatggggccg ggccgaggtg   5700
caatctgttt cgctgccgcc gcctgagggg ctggtggccg gtagtgaagc tgaaggaggc   5760
agaggacgtg gagcgggagg cgcaggaggc tcaggctgga agaagaagc gaaagcagag   5820
gaggaggaag ggccggccag aagacctgga gttcacagac atgggtggca atgtgtacat   5880
cctcacggga aggtggagg cagagtttga gctgctgact gtggaggagg ccgagaaacg   5940
gccagtgggg aaggggcgga agcagccaga gcctctggag aaacccagcc gccccaaaac   6000
```

TABLE LII(e)-continued

Nucleotide sequence of transcript variant 158P3D2 v.17

```
ttccttcaac tggtttgtga acccgctgaa gacctttgtc ttcttcatct ggcgccggta    6060
ctggcgcacc ctggtgctgc tgctactggt gctgctcacc gtcttcctcc tcctggtctt    6120
ctacaccatc cctggccaga tcagccaggt catcttccgt cccctccaca agtgactctc    6180
gctgaccttg gacactcacc cagggtgcca acccttcaat gcctgctcct ggaagtcttt    6240
cttacccatg tgagctaccc cagagtctag tgcttcctct gaataaacct atcacagcc     6299
```

TABLE LIII(e)

Nucleotide sequence alignment of 121P1F1 v.1 (SEQ
ID NO: 357) and 158P3D2 v.17 (SEQ ID NO: 358)

Score = 2165 bits (1126), Expect = 0.0 Identities = 1126/1126 (100%)
Strand = Plus/Plus

```
V.1:     834 cagggatctcttcacatgtggattgacatctttcctcaagatgtgcctgctccaccccca  893
             ||||||||||||||||||||||||||||||||||||||||||||||||||||||||||||
V.17:   5174 cagggatctcttcacatgtggattgacatctttcctcaagatgtgcctgctccaccccca  5233

V.1:     894 gttgacatcaagcctcggcagccaatcagctatgagctcagagttgtcatctggaacacg  953
             ||||||||||||||||||||||||||||||||||||||||||||||||||||||||||||
V.17:   5234 gttgacatcaagcctcggcagccaatcagctatgagctcagagttgtcatctggaacacg  5293

V.1:     954 gaggatgtggttctggatgacgagaatccactcaccggagagatgtcgagtgacatctat  1013
             ||||||||||||||||||||||||||||||||||||||||||||||||||||||||||||
V.17:   5294 gaggatgtggttctggatgacgagaatccactcaccggagagatgtcgagtgacatctat  5353

V.1:    1014 gtgaagagctgggtgaaggggttggagcatgacaagcaggagacagacgttcacttcaac  1073
             ||||||||||||||||||||||||||||||||||||||||||||||||||||||||||||
V.17:   5354 gtgaagagctgggtgaaggggttggagcatgacaagcaggagacagacgttcacttcaac  5413

V.1:    1074 tccctgactggggagggaacttcaattggcgctttgtgttccgctttgactacctgccc   1133
             ||||||||||||||||||||||||||||||||||||||||||||||||||||||||||||
V.17:   5414 tccctgactggggagggaacttcaattggcgctttgtgttccgctttgactacctgccc   5473

V.1:    1134 acggagcgggaggtgagcgtctggcgcaggtctggacccttcgccctggaggaggcggag  1193
             ||||||||||||||||||||||||||||||||||||||||||||||||||||||||||||
V.17:   5474 acggagcgggaggtgagcgtctggcgcaggtctggacccttcgccctggaggaggcggag  5533

V.1:    1194 ttccggcagcctgcagtgctggtcctgcaggtctgggactatgaccgcatctctgccaat  1253
             ||||||||||||||||||||||||||||||||||||||||||||||||||||||||||||
V.17:   5534 ttccggcagcctgcagtgctggtcctgcaggtctgggactatgaccgcatctctgccaat  5593

V.1:    1254 gacttccttggatccctggagttgcagctaccagacatggtgcgtggggcccggggcccc  1313
             ||||||||||||||||||||||||||||||||||||||||||||||||||||||||||||
V.17:   5594 gacttccttggatccctggagttgcagctaccagacatggtgcgtggggcccggggcccc  5653

V.1:    1314 gagctctgctctgtgcagctggcccgcaatggggccgggccgaggtgcaatctgtttcgc  1373
             ||||||||||||||||||||||||||||||||||||||||||||||||||||||||||||
V.17:   5654 gagctctgctctgtgcagctggcccgcaatggggccgggccgaggtgcaatctgtttcgc  5713

V.1:    1374 tgccgccgcctgagggggctggtggccggtagtgaagctgaaggaggcagaggacgtggag  1433
             ||||||||||||||||||||||||||||||||||||||||||||||||||||||||||||
V.17:   5714 tgccgccgcctgagggggctggtggccggtagtgaagctgaaggaggcagaggacgtggag  5773

V.1:    1434 cgggaggcgcaggaggctcaggctggcaagaagaagcgaaagcagaggaggaggaagggc  1493
             ||||||||||||||||||||||||||||||||||||||||||||||||||||||||||||
V.17:   5774 cgggaggcgcaggaggctcaggctggcaagaagaagcgaaagcagaggaggaggaagggc  5833

V.1:    1494 cggccagaagacctggagttcacagacatgggtggcaatgtgtacatcctcacgggcaag  1553
             ||||||||||||||||||||||||||||||||||||||||||||||||||||||||||||
V.17:   5834 cggccagaagacctggagttcacagacatgggtggcaatgtgtacatcctcacgggcaag  5893
```

TABLE LIII(e)-continued

Nucleotide sequence alignment of 121P1F1 v.1 (SEQ ID NO: 357) and 158P3D2 v.17 (SEQ ID NO: 358)

```
V.1:   1554 gtggaggcagagtttgagctgctgactgtggaggaggccgagaaacggccagtggggaag 1613
            ||||||||||||||||||||||||||||||||||||||||||||||||||||||||||||
V.17:  5894 gtggaggcagagtttgagctgctgactgtggaggaggccgagaaacggccagtggggaag 5953

V.1:   1614 gggcggaagcagccagagcctctggagaaacccagccgccccaaaacttccttcaactgg 1673
            ||||||||||||||||||||||||||||||||||||||||||||||||||||||||||||
V.17:  5954 gggcggaagcagccagagcctctggagaaacccagccgccccaaaacttccttcaactgg 6013

V.1:   1674 tttgtgaacccgctgaagacctttgtcttcttcatctggcgccggtactggcgcaccctg 1733
            ||||||||||||||||||||||||||||||||||||||||||||||||||||||||||||
V.17:  6014 tttgtgaacccgctgaagacctttgtcttcttcatctggcgccggtactggcgcaccctg 6073

V.1:   1734 gtgctgctgctactggtgctgctcaccgtcttcctcctcctggtcttctacaccatccct 1793
            ||||||||||||||||||||||||||||||||||||||||||||||||||||||||||||
V.17:  6074 gtgctgctgctactggtgctgctcaccgtcttcctcctcctggtcttctacaccatccct 6133

V.1:   1794 ggccagatcagccaggtcatcttccgtcccctccacaagtgactctcgctgaccttggac 1853
            ||||||||||||||||||||||||||||||||||||||||||||||||||||||||||||
V.17:  6134 ggccagatcagccaggtcatcttccgtcccctccacaagtgactctcgctgaccttggac 6193

V.1:   1854 actcacccagggtgccaaccttcaatgcctgctcctggaagtctttcttacccatgtga 1913
            ||||||||||||||||||||||||||||||||||||||||||||||||||||||||||||
V.17:  6194 actcacccagggtgccaaccttcaatgcctgctcctggaagtctttcttacccatgtga 6253

V.1:   1914 gctaccccagagtctagtgcttcctctgaataaacctatcacagcc              1959
            ||||||||||||||||||||||||||||||||||||||||||||||
V.17:  6254 gctaccccagagtctagtgcttcctctgaataaacctatcacagcc              6299

Score = 300 bits (156), Expect = 7e-78 Identities = 156/156 (100%)
Strand = Plus/Plus V.1:    682 agatggttacaatgcctggcgtgatgcattctggccttcgcagatcctggcggggctgtg  741
            ||||||||||||||||||||||||||||||||||||||||||||||||||||||||||||
V.17:  4861 agatggttacaatgcctggcgtgatgcattctggccttcgcagatcctggcggggctgtg 4920

V.1:    742 ccaacgctgtggcctccctgcccctgaataccgagccggtgctgtcaaggtgggcagcaa  801
            ||||||||||||||||||||||||||||||||||||||||||||||||||||||||||||
V.17:  4921 ccaacgctgtggcctccctgcccctgaataccgagccggtgctgtcaaggtgggcagcaa 4980

V.1:    802 agtcttcctgacaccaccggagaccctgcccccagg                          837
            ||||||||||||||||||||||||||||||||||||
V.17:  4981 agtcttcctgacaccaccggagaccctgcccccagg                         5016
```

TABLE LIV(e)

Peptide sequences of protein coded by 158P3D2 v.17

(SEQ ID NO: 359)

```
MALTVSVQRL TGLTGTHDRQ VKLTFRGFTQ KTRKIHCGPE ADIGELFRWP HYGAPLAGEC    60

LSVQVVNCSR VFSLRPLGTL VISLQQLQNA GHLVLREALV DENLQVSPIQ VELDLKYQPP   120

EGATGAWSEE DFGAPIQDSF ELIIPNVGFQ ELEPGEAQLE RRAVALGRRL ARSLGQQDDE   180

ENELELELEQ DLDDEPDVEL SGVMFSPLKS RARALAHGDP FQVSRAQDFQ VGVTVLEAQK   240

LVGVNINPYV AVQVGGQRRV TATQRGTSCP FYNEYFLFEF HDTRLRLQDL LLEITVSGVG   300

VTSVLQRRGD EKAAGLTPPS PKAFHSQTLP FMATRIGTFR MDLGIILDQP DGQFYQRWVP   360

LHDPRDTRAG TKGFIKVTLS VRARGDLPPP MLPPAPGHCS DIEKNLLLPR GVPAERPWAR   420

LRVRLYRAEG LPALRLGLLG SLVRALHDQR VLVEPYVRVS FLGQEGETSV SAEAAAPEWN   480

EQLSFVELFP PLTRSLRLQL RDDAPLVDAA LATHVPDLRR ISHPGRAAGF NPTFGPAWVP   540

LYGSPPGAGL RDSLQGLNEG VGQGIWFRGR LLLAVSMQVL EGRAEPEPPQ AQQGSTLSRL   600
```

TABLE LIV(e)-continued

Peptide sequences of protein coded by 158P3D2 v.17

```
TRKKKKKARR DQTPKAVPQH LDASPGAEGP EIPRAMEVEV EELLPLPENV LAPCEDFLLF      660
GVLFEATMID PTVASQPISF EISIGRAGRL EEQLGRGSRA GEGTEGAAVE AQPLLGARPE      720
EEKEEEELGT HAQRPEPMDG SGPYFCLPLC HCKPCMHVWS CWEDHTWRLQ SSNCVRKVAE      780
RLDQGLQEVE RLQRKPGPGA CAQLKQALEV LVAGSRQFCH GAERRTMTRP NALDRCRGKL      840
LVHSLNLLAK QGLRLLRGLR RRNVQKKVAL AKKLLAKLRF LAEEPQPPLP DVLVWMLSGQ      900
RRVAWARIPA QDVLFSVVEE ERGRDCGKIQ SLMLTAPGAA PGEVCAKLEL FLRLGLGKQA      960
KACTSELPPD LLPEPSAGLP SSLHRDDFSY FQLRAHLYQA RGVLAADDSG LSDPFARVLI     1020
STQCQTTRVL EQTLSPLWDE LLVFEQLIVD GRREHLQEEP PLVIINVFDH NKFGPPVFLG     1080
RALAAPRVKL MEDPYQRPEL QFFPLRKGPW AAGELIAAFQ LIELDYSGRL EPSVPSEVEP     1140
QDLAPLVEPH SGRLSLPPNV CPVLREFRVE VLFWGLRGLG RVHLLEVEQP QVVLEVAGQG     1200
VESEVLASYR ESPNFTELVR HLTVVFKDTA PLFHPQDLPE QPYLQPPLSI LVIERRAFGH     1260
TVLVGSHIVP HMLRFTFRGH EDPPEEEGEM EETGDMMPKG PQGQKSLDPF LAEAGISRQL     1320
LKPPLKKLPL GGLLNQGPGL EEDIPDPEEL DWGSKYYASL QELQGQHNFD EDEMDDPGDS     1380
DGVNLISMVG EIQDQGEAEV KGTVSPKKAV ATLKIYNRSL KEEFNHFEDW LNVFPLYRGQ     1440
GGQDGGGEEE GSGHLVGKFK GSFLIYPESE AVLFSEPQIS RGIPQNRPIK LLVRVYVVKA     1500
TNLAPADPNG KADPYVVVSA GRERQDTKER YIPKQLNPIF GEILELSISL PAETELTVAV     1560
FDHDLVGSDD LIGETHIDLE NRFYSHHRAN CGLASQYEVD GYNAWRDAFW PSQILAGLCQ     1620
RCGLPAPEYR AGAVKVGSKV FLTPPETLPP GSSSPTVASG DPEEAQALLV LRRWQEMPGF     1680
GIQLVPEHVE TRPLYHPHSP GLLQGSLHMW IDIFPQDVPA PPPVDIKPRQ PISYELRVVI     1740
WNTEDVVLDD ENPLTGEMSS DIYVKSWVKG LEHDKQETDV HFNSLTGEGN FNWRFVFRFD     1800
YLPTEREVSV WRRSGPFALE EAEFRQPAVL VLQVWDYDRI SANDFLGSLE LQLPDMVRGA     1860
RGPELCSVQL ARNGAGPRCN LFRCRRLRGW WPVVKLKEAE DVEREAQEAQ AGKKKRKQRR     1920
RKGRPEDLEF TDMGGNVYIL TGKVEAEFEL LTVEEAEKRP VGKGRKQPEP LEKPSRPKTS     1980
FNWFVNPLKT FVFFIWRRYW RTLVLLLLVL LTVFLLLVFY TIPGQISQVI FRPLHK        2036
```

TABLE LV(e)

Amino acid sequence alignment of 121P1F1 v.1
(SEQ ID NO: 360) and 158P3D2 v.17 (SEQ ID NO: 361)

```
Score = 679 bits (1751), Expect = 0.0 Identities = 328/328
(100%), Positives = 328/328 (100%)

V.1:     1 MWIDIFPQDVPAPPPVDIKPRQPISYELRVVIWNTEDVVLDDENPLTGEMSSDIYVKSWV     60
           MWIDIFPQDVPAPPPVDIKPRQPISYELRVVIWNTEDVVLDDENPLTGEMSSDIYVKSWV
v.17: 1709 MWIDIFPQDVPAPPPVDIKPRQPISYELRVVIWNTEDVVLDDENPLTGEMSSDIYVKSWV   1768

V.1:    61 KGLEHDKQETDVHFNSLTGEGNFNWRFVFRFDYLPTEREVSVWRRSGPFALEEAEFRQPA    120
           KGLEHDKQETDVHFNSLTGEGNFNWRFVFRFDYLPTEREVSVWRRSGPFALEEAEFRQPA
v.17: 1769 KGLEHDKQETDVHFNSLTGEGNFNWRFVFRFDYLPTEREVSVWRRSGPFALEEAEFRQPA   1828

V.1:   121 VLVLQVWDYDRISANDFLGSLELQLPDMVRGARGPELCSVQLARNGAGPRCNLFRCRRLR    180
           VLVLQVWDYDRISANDFLGSLELQLPDMVRGARGPELCSVQLARNGAGPRCNLFRCRRLR
v.17: 1829 VLVLQVWDYDRISANDFLGSLELQLPDMVRGARGPELCSVQLARNGAGPRCNLFRCRRLR   1888

V.1:   181 GWWPVVKLKEAEDVEREAQEAQAGKKKRKQRRRKGRPEDLEFTDMGGNVYILTGKVEAEF    240
           GWWPVVKLKEAEDVEREAQEAQAGKKKRKQRRRKGRPEDLEFTDMGGNVYILTGKVEAEF
v.17: 1889 GWWPVVKLKEAEDVEREAQEAQAGKKKRKQRRRKGRPEDLEFTDMGGNVYILTGKVEAEF   1948

V.1:   241 ELLTVEEAEKRPVGKGRKQPEPLEKPSRPKTSFNWFVNPLKTFVFFIWRRYWRTLVLLLL    300
           ELLTVEEAEKRPVGKGRKQPEPLEKPSRPKTSFNWFVNPLKTFVFFIWRRYWRTLVLLLL
v.17: 1949 ELLTVEEAEKRPVGKGRKQPEPLEKPSRPKTSFNWFVNPLKTFVFFIWRRYWRTLVLLLL   2008
```

TABLE LV(e)-continued

Amino acid sequence alignment of 121P1F1 v.1 (SEQ ID NO: 360) and 158P3D2 v.17 (SEQ ID NO: 361)

```
V.1:     301 VLLTVFLLLVFYTIPGQISQVIFRPLHK                                328
             VLLTVFLLLVFYTIPGQISQVIFRPLHK
v.17:2009    VLLTVFLLLVFYTIPGQISQVIFRPLHK                                2036
```

TABLE LII(f)

Nucleotide sequence of transcript variant 158P3D2 v.18

(SEQ ID NO: 362)

```
agaagaaagc tggtaggggc tgggagaggg taccacaggg gagtatgatc tacttggggg      60
ccagagaagg ttccctgagg aaatagtacc tgaacttaga cttgaaggat aacagatgtt     120
aactgggagg agagaatgtt ccaggcagag gaaaaggcat atgcaaaagt ccagcgcctt     180
gaaggagcac agctgggtg cctggagtga gatggagctg gaaagatcca ggtggagctt      240
gacctgaagt accagccccc agagggcgct actggagcct ggtcagagga ggactttggg     300
gcacccatcc aggacagctt cgagttaatc atccccaatg tgggcttcca ggaactggag     360
cctggggagg cccagctgga gcggcgggca gtggctctag gccgcaggct agctcgaagt     420
ctaggccagc aggacgatga agagaatgag ctggagcttg agctggagca ggacctggat     480
gatgagcctg acgtggaact ttctggtgtt atgttcagcc cctcaagag ccgcgccagg      540
gccctggccc atggggatcc cttccaggtg tccagagctc aagacttcca ggtgggagtc     600
actgtgctgg aagcccagaa actggtggga gtcaacatta ccccctatgt ggccgtgcaa     660
gtgggggggc agcgccgtgt gaccgccaca cagcgtggga ccagttgccc cttctacaat     720
gagtacttct tgttcgaatt tcatgacacg cggcttcgtc tccaagactt gctgctggag     780
atcacggtga gtggggtagg ggtgaccagt gtccttcaga aaggggga tgagaaagct       840
gcaggactaa caccaccttc ccccaaggct ttccattcgc agaccctccc ctttatggcc     900
acccggatag gcaccttcag gatggacctg ggcatcatct tggaccagcc aggtatggaa     960
tcgtccccctt attgagactc tgcacggaca agggccctag agattgaccc tgcagtgact    1020
ccgcatggac ccctatacac tcacttcgga gagggccatc tctggcggag gctgaactct    1080
tggcacttcc gccccctccct gctgagccag agaagccctg gccattgtcc gtcactccga    1140
tagcctcacg gccaccctgt gcgtcccgcc ggtcgcccct tacccctggc tcgccccttc    1200
gcccttagat ggccagttct accaaagatg ggttccgctg catgatcccc gagacacccg    1260
cgccgggacc aagggtttca ttaaggtcac cttgtccgtg agggcgcgcg ggacctgcc    1320
ccctccaatg ctaccccgg ccccagggca ctgttcggac atcgagaagt gagccggggt     1380
gaggtgggga ggaggacatg gatccggggg tggccgtggg gcgcggataa ggggaggggc    1440
cgagatccca gtttctcccc ccccgctcgg tgccccctcc cctaggaacc tgctcctgcc    1500
gcgcggggtg cccgccgaga ggccatgggc gcggctccgc gtgcgcctgt accgcgccga    1560
ggggcttccc gcgctgcgcc tggggctgct gggcagcctg gtccgcgccc tgcacgacca    1620
gcgcgtcctg gtggagccct atgtgcgggt gtctttcctg gggcaggagg gcgagacgtc    1680
ggtgagcgcc gaggcggcgg cgcccgaatg gaacgagcag ctgagcttcg tggagctctt    1740
cccgccgctg acgcgcagcc tccgcctgca gctgcgggac gacgcgcccc tggtcgacgc    1800
ggcactcgct acgcacgtgc cggacctgag gcggatctcc catccggggcc gcggcggg    1860
gtttaaccct accttcggcc cggcctgggt gcccctctat ggctcgcccc ccggcgcggg    1920
```

TABLE LII(f)-continued

Nucleotide sequence of transcript variant 158P3D2 v.18

| | | | | |
|---|---|---|---|---|
| gctccgggat | agtcttcaag | gtctcaacga | aggcgttggc | caaggcattt ggttccgcgg | 1980 |
| ccgccttctg | ctggctgtgt | ccatgcaggt | gttggaaggg | agagctgaac ctgagcctcc | 2040 |
| ccaggcccag | caggggtcca | cgttgtcccg | gctcacccga | aagaagaaaa agaaagccag | 2100 |
| aagggatcag | accccaaagg | cggttccgca | gcacttggac | gccagccccg gtgccgaggg | 2160 |
| gcctgagatc | ccccgtgcca | tggaggtgga | ggtggaggag | ctgctgccgc tgccagagaa | 2220 |
| tgtcctggcg | ccctgtgaag | atttcctgct | tttcggtgtg | ctcttcgagg ccaccatgat | 2280 |
| cgaccccacc | gtggcctccc | agcccatcag | cttcgagatc | tccattggtg tgtggcctag | 2340 |
| ccgaacccct | gagtgccatt | tcagaccctta | gaaccctgga | aggggtgttg actttcagtc | 2400 |
| gcgcaggccg | tctggaggag | caattgggcc | gagggtccag | ggctggggag ggaactgagg | 2460 |
| gtgcagccgt | ggaggctcag | cctctgctgg | gagccaggcc | agaggaggag aaagaggagg | 2520 |
| aagaactggg | gacccatgct | cagcggcctg | agcccatgga | cggcagtggg ccatacttct | 2580 |
| gcttgcccct | ctgtcactgc | aagccatgca | tgcatgtgtg | gagttgctgg gaggaccaca | 2640 |
| cctggcgcct | gcagagcagc | aactgcgtgc | gcaaagtggc | cgagaggctg accaggggc | 2700 |
| tgcaggaggt | tgagagactg | cagcgcaagc | cggggcctgg | cgcctgtgca cagctcaagc | 2760 |
| aggcactgga | agtactggtg | gctgggagca | gacagttttg | ccacggtgcc gagcgcagga | 2820 |
| cgatgacccg | gcccaatgcc | ctggatcgat | gccgagggaa | actcctggtg cacagcctga | 2880 |
| accttttggc | taagcaagga | ctgcgacttc | tacgcggcct | gagacggcgc aatgtgcaaa | 2940 |
| agaaggtggc | actggccaag | aagctcctgg | caaaactgcg | ctttctggct gaggaggcac | 3000 |
| ccggggcagc | ccctggtgag | gtctgtgcca | agctggagct | cttcctgcgg ctgggcctgg | 3060 |
| gcaagcaagc | caaggcctgc | acctctgagc | tgccccggga | tttgctgccc gagccctcag | 3120 |
| ccgggctgcc | ctccagccta | caccgggacg | gtcctggagc | agacgctgag ccctctgtgg | 3180 |
| gatgaactcc | tggtatttga | gcagttgatc | gtggatggga | ggagggagca cctgcaggag | 3240 |
| gagcctccat | tagtgatcat | caatgtattt | gaccacaata | agtttggccc ccccgtgttc | 3300 |
| ctgggcaggg | cactggccgc | cccaagggta | aagctgatgg | aggacccata ccaacgccca | 3360 |
| gagttgcagt | tcttcccct | gaggaaggga | ccctgggcag | ccggagagct cattgccgcc | 3420 |
| tttcaactca | ttgaactaga | ctacagtggc | cgacttgagc | cctcagtgcc cagtgaggtg | 3480 |
| gagcccagg | atctggcacc | cctggttgag | ccccactctg | gacgcctgtc ccttccaccc | 3540 |
| aacgtgtgcc | cagtgctcag | ggagttccgt | gttgaggtgc | tgttctgggg tcttagggga | 3600 |
| cttggtcgtg | tgcatctgct | cgaggtggag | cagccccagg | ttgtactgga ggtggctggg | 3660 |
| caaggtgtgg | agtctgaggt | cctggccagc | taccgtgaga | gccccaattt cactgagctt | 3720 |
| gtcaggcatc | tgacagtggt | cttcaaagac | acagctcctc | tcttccaccc ccaggacttg | 3780 |
| ccggagcagc | cttacttgca | gcctccactc | agcatcttgg | tgattgagcg ccgggccttt | 3840 |
| ggccacacag | tccttgtggg | ttcccacatt | gtcccccaca | tgctgcgatt cacatttcgg | 3900 |
| ggtcatgagg | atcctcctga | ggaggaagga | gagatggagg | agacagggga tatgatgccc | 3960 |
| aagggacctc | aaggacagaa | gtccctggat | cccttcttgg | ctgaagcggg tatatccaga | 4020 |
| cagctcctga | agcacaactt | tgatgaagat | gaaatggatg | atcctggaga ttcagatggg | 4080 |
| gtcaacctca | tttctatggt | tggggagatc | caagaccagg | gtgaggctga agtcaaaggc | 4140 |
| actgtgtccc | caaaaaaagc | agttgccacc | ctgaagatct | acaacaggtc cctgaaggaa | 4200 |
| gaatttaacc | actttgaaga | ctggctgaat | gtgtttcctc | tgtaccgagg gcaaggggc | 4260 |

TABLE LII(f)-continued

Nucleotide sequence of transcript variant 158P3D2 v.18

| | | | | | |
|---|---|---|---|---|---|
| caggatggag | gtggagaaga | ggaaggatct | ggacaccttg | tgggcaagtt | caagggctcc | 4320 |
| ttcctcattt | accctgaatc | agaggcagtg | ttgttctctg | agccccagat | ctcccggggg | 4380 |
| atcccacaga | accggcccat | caagctcctg | gtcagagtgt | atgttgtaaa | ggctaccaac | 4440 |
| ctggctcctg | cagaccccaa | tggcaaagca | gacccttacg | tggtggtgag | cgctggccgg | 4500 |
| gagcggcagg | acaccaagga | acgctacatc | cccaagcagc | tcaacccat | ctttggagag | 4560 |
| atcctggagc | taagcatctc | tctcccagct | gagacggagc | tgacggtcgc | cgtatttgat | 4620 |
| catgacctcg | tgggttctga | cgacctcatc | ggggagaccc | acattgatct | ggaaaaccga | 4680 |
| ttctatagcc | accacagagc | aaactgtggg | ctggcctccc | agtatgaagt | gtgggtccag | 4740 |
| cagggcccac | aggagccatt | ctgagtttct | ggccaaacac | attcaagctc | acattccctt | 4800 |
| ttgtgtctcc | agatcctatg | atttcatgga | aggggaccct | ccacccacc | gccactgcca | 4860 |
| accaagacat | agctcagtgg | tcaagacttg | ggcttgggag | tcgggatcct | gtaacgaatg | 4920 |
| tcacttgacc | gctttctttt | tttatgaaac | agtctcgctc | tgtctcccag | gttggagtgc | 4980 |
| agtggcacga | tctcggctga | ctgcaacctc | cacctcctgg | gttcaagcga | ttctcctgcc | 5040 |
| tcagcctccc | cagtagctgg | gattacaggc | gtgggccccc | atgtccagct | aatttttata | 5100 |
| ttttcgctct | gtctcccagg | ttggagtgca | gtggcacgat | ctcggctgac | tgcaacctcc | 5160 |
| acctcctggg | ttcaagcgat | tctcctgcct | cagcctcccc | agtagctggg | attacaggcg | 5220 |
| tgggccccca | tgtccagcta | attttatat | ttttagtaga | cagggtttt | caccatgttg | 5280 |
| tccaggctgg | tcttgaaccc | ctgacctcaa | gtgatccacc | cacctctgcc | tcccaaagtg | 5340 |
| ctgggattac | aggtgtgagc | caccatgcca | ggccctctta | acctcttcaa | gtctgttttc | 5400 |
| tcatctgcaa | aacagaggta | ataagatcag | tatcttctta | atggaagcac | ctggactaca | 5460 |
| ttttttcat | tcattgttat | cataaatgag | gactaacctg | tctcccgttg | ggagttttga | 5520 |
| acctagacct | catgtcttca | tgacgtcatc | actgccccag | gccagctgt | gtccctacac | 5580 |
| cagccccagc | tgacgcatct | tcttttttctg | cctgtagaga | tggttacaat | gcctggcgtg | 5640 |
| atgcattctg | gccttcgcag | atcctggcgg | ggctgtgcca | acgctgtggc | ctccctgccc | 5700 |
| ctgaataccg | agccggtgct | gtcaaggtgg | gcagcaaagt | cttcctgaca | ccaccggaga | 5760 |
| ccctgccccc | agggatctct | tcacatgtgg | attgacatct | ttcctcaaga | tgtgcctgct | 5820 |
| ccaccccag | ttgacatcaa | gcctcggcag | ccaatcagct | atgagctcag | agttgtcatc | 5880 |
| tggaacacgg | aggatgtggt | tctggatgac | gagaatccac | tcaccggaga | gatgtcgagt | 5940 |
| gacatctatg | tgaagagctg | ggtgaagggg | ttggagcatg | acaagcagga | gacagacgtt | 6000 |
| cacttcaact | ccctgactgg | ggaggggaac | ttcaattggc | gctttgtgtt | ccgcttgac | 6060 |
| tacctgccca | cggagcggga | ggtgagcgtc | tggcgcaggt | ctggacccct | tgccctggag | 6120 |
| gaggcggagt | tccggcagcc | tgcagtgctg | gtcctgcagg | atccctggag | ttgcagctac | 6180 |
| cagacatggt | gcgtggggcc | cggggccccg | agctctgctc | tgtgcagctg | gcccgcaatg | 6240 |
| gggccgggcc | gaggtgcaat | ctgtttcgct | gccgccgcct | gaggggctgg | tggccggtag | 6300 |
| tgaagctgaa | ggaggcagag | gacgtggagc | gggaggcgca | ggaggctcag | gctggcaaga | 6360 |
| agaagcgaaa | gcagaggagg | aggaagggcc | ggccagaaga | cctggagttc | acagacatgg | 6420 |
| gtggcaatgt | gtacatcctc | acgggcaagg | tggaggcaga | gtttgagctg | ctgactgtgg | 6480 |
| aggaggccga | gaaacggcca | gtggggaagg | ggcggaagca | gccagagcct | ctggagaaac | 6540 |
| ccagccgccc | caaaacttcc | ttcaactggt | ttgtgaaccc | gctgaagacc | tttgtcttct | 6600 |

TABLE LII(f)-continued

Nucleotide sequence of transcript variant 158P3D2 v.18

```
tcatctggcg ccggtactgg cgcaccctgg tgctgctgct actggtgctg ctcaccgtct    6660
tcctcctcct ggtcttctac accatccctg gccagatcag ccaggtcatc ttccgtcccc    6720
tccacaagtg actctcgctg accttggaca ctcacccagg gtgccaaccc ttcaatgcct    6780
gctcctggaa gtctttctta cccatgtgag ctacccagda gtctagtgct tcctctgaat    6840
aaacctatca cagcc                                                      6855
```

TABLE LIII(f)

Nucleotide sequence alignment of 121P1F1 v.1 (SEQ ID NO: 363) and 158P3D2 v.18 (SEQ ID NO: 364)

Score = 2354 bits (1224), Expect = 0.0 Identities = 1224/1224 (100%)
Strand = Plus/Plus

```
V.1:      1 ttttttatgaaacagtctcgctctgtctcccaggttggagtgcagtggcacgatctcgg   60
            ||||||||||||||||||||||||||||||||||||||||||||||||||||||||||||
V.18:  4937 ttttttatgaaacagtctcgctctgtctcccaggttggagtgcagtggcacgatctcgg 4996

V.1:     61 ctgactgcaacctccacctcctgggttcaagcgattctcctgcctcagcctccccagtag  120
            ||||||||||||||||||||||||||||||||||||||||||||||||||||||||||||
V.18:  4997 ctgactgcaacctccacctcctgggttcaagcgattctcctgcctcagcctccccagtag 5056

V.1:    121 ctgggattacaggcgtgggcccccatgtccagctaattttttatattttcgctctgtctcc  180
            ||||||||||||||||||||||||||||||||||||||||||||||||||||||||||||
V.18:  5057 ctgggattacaggcgtgggcccccatgtccagctaattttttatattttcgctctgtctcc 5116

V.1:    181 caggttggagtgcagtggcacgatctcggctgactgcaacctccacctcctgggttcaag  240
            ||||||||||||||||||||||||||||||||||||||||||||||||||||||||||||
V.18:  5117 caggttggagtgcagtggcacgatctcggctgactgcaacctccacctcctgggttcaag 5176

V.1:    241 cgattctcctgcctcagcctccccagtagctgggattacaggcgtgggcccccatgtcca  300
            ||||||||||||||||||||||||||||||||||||||||||||||||||||||||||||
V.18:  5177 cgattctcctgcctcagcctccccagtagctgggattacaggcgtgggcccccatgtcca 5236

V.1:    301 gctaattttttatattttttagtagagacagggtttcaccatgttgtccaggctggtcttga  360
            ||||||||||||||||||||||||||||||||||||||||||||||||||||||||||||
V.18:  5237 gctaattttttatattttttagtagagacagggtttcaccatgttgtccaggctggtcttga 5296

V.1:    361 accctgacctcaagtgatccacccacctctgcctcccaaagtgctgggattacaggtgt  420
            ||||||||||||||||||||||||||||||||||||||||||||||||||||||||||||
V.18:  5297 accctgacctcaagtgatccacccacctctgcctcccaaagtgctgggattacaggtgt 5356

V.1:    421 gagccaccatgccaggccctcttaacctcttcaagtctgttttctcatctgcaaaacaga  480
            ||||||||||||||||||||||||||||||||||||||||||||||||||||||||||||
V.18:  5357 gagccaccatgccaggccctcttaacctcttcaagtctgttttctcatctgcaaaacaga 5416

V.1:    481 ggtaataagatcagtatcttcttaatggaagcacctggactacattttttcattcattg  540
            ||||||||||||||||||||||||||||||||||||||||||||||||||||||||||||
V.18:  5417 ggtaataagatcagtatcttcttaatggaagcacctggactacattttttcattcattg 5476

V.1:    541 ttatcataaatgaggactaacctgtctcccgttgggagttttgaacctagacctcatgtc  600
            ||||||||||||||||||||||||||||||||||||||||||||||||||||||||||||
V.18:  5477 ttatcataaatgaggactaacctgtctcccgttgggagttttgaacctagacctcatgtc 5536

V.1:    601 ttcatgacgtcatcactgccccaggcccagctgtgtccctacaccagcccagctgacgc  660
            ||||||||||||||||||||||||||||||||||||||||||||||||||||||||||||
V.18:  5537 ttcatgacgtcatcactgccccaggcccagctgtgtccctacaccagcccagctgacgc 5596

V.1:    661 atcttctttttctgcctgtagagatggttacaatgcctggcgtgatgcattctggccttc  720
            ||||||||||||||||||||||||||||||||||||||||||||||||||||||||||||
V.18:  5597 atcttctttttctgcctgtagagatggttacaatgcctggcgtgatgcattctggccttc 5656
```

TABLE LIII(f)-continued

Nucleotide sequence alignment of 121P1F1 v.1 (SEQ ID NO: 363) and 158P3D2 v.18 (SEQ ID NO: 364)

```
V.1:    721 gcagatcctggcggggctgtgccaacgctgtggcctccctgcccctgaataccgagccgg  780
            ||||||||||||||||||||||||||||||||||||||||||||||||||||||||||||
V.18:  5657 gcagatcctggcggggctgtgccaacgctgtggcctccctgcccctgaataccgagccgg  5716

V.1:    781 tgctgtcaaggtgggcagcaaagtcttcctgacaccaccggagaccctgcccccagggat  840
            ||||||||||||||||||||||||||||||||||||||||||||||||||||||||||||
V.18:  5717 tgctgtcaaggtgggcagcaaagtcttcctgacaccaccggagaccctgcccccagggat  5776

V.1:    841 ctcttcacatgtggattgacatctttcctcaagatgtgcctgctccaccccagttgaca  900
            ||||||||||||||||||||||||||||||||||||||||||||||||||||||||||||
V.18:  5777 ctcttcacatgtggattgacatctttcctcaagatgtgcctgctccaccccagttgaca  5836

V.1:    901 tcaagcctcggcagccaatcagctatgagctcagagttgtcatctggaacacggaggatg  960
            ||||||||||||||||||||||||||||||||||||||||||||||||||||||||||||
V.18:  5837 tcaagcctcggcagccaatcagctatgagctcagagttgtcatctggaacacggaggatg  5896

V.1:    961 tggttctggatgacgagaatccactcaccggagagatgtcgagtgacatctatgtgaaga  1020
            ||||||||||||||||||||||||||||||||||||||||||||||||||||||||||||
V.18:  5897 tggttctggatgacgagaatccactcaccggagagatgtcgagtgacatctatgtgaaga  5956

V.1:   1021 gctgggtgaaggggttggagcatgacaagcaggagacagacgttcacttcaactccctga  1080
            ||||||||||||||||||||||||||||||||||||||||||||||||||||||||||||
V.18:  5957 gctgggtgaaggggttggagcatgacaagcaggagacagacgttcacttcaactccctga  6016

V.1:   1081 ctggggagggaacttcaattggcgctttgtgttccgctttgactacctgcccacggagc  1140
            ||||||||||||||||||||||||||||||||||||||||||||||||||||||||||||
V.18:  6017 ctggggagggaacttcaattggcgctttgtgttccgctttgactacctgcccacggagc  6076

V.1:   1141 gggaggtgagcgtctggcgcaggtctggaccctttgccctggaggaggcggagttccggc  1200
            ||||||||||||||||||||||||||||||||||||||||||||||||||||||||||||
V.18:  6077 gggaggtgagcgtctggcgcaggtctggaccctttgccctggaggaggcggagttccggc  6136

V.1:   1201 agcctgcagtgctggtcctgcagg                                      1224
            ||||||||||||||||||||||||
V.18:  6137 agcctgcagtgctggtcctgcagg                                      6160
```

Score = 1340 bits (697), Expect = 0.0 Identities = 697/697 (100%)
Strand = Plus/Plus

```
V.1:   1263 ggatccctggagttgcagctaccagacatggtgcgtggggcccggggccccgagctctgc  1322
            ||||||||||||||||||||||||||||||||||||||||||||||||||||||||||||
V.18:  6159 ggatccctggagttgcagctaccagacatggtgcgtggggcccggggccccgagctctgc  6218

V.1:   1323 tctgtgcagctggcccgcaatggggccgggccgaggtgcaatctgtttcgctgccgccgc  1382
            ||||||||||||||||||||||||||||||||||||||||||||||||||||||||||||
V.18:  6219 tctgtgcagctggcccgcaatggggccgggccgaggtgcaatctgtttcgctgccgccgc  6278

V.1:   1383 ctgaggggctggtggccggtagtgaagctgaaggaggcagaggacgtggagcgggaggcg  1442
            ||||||||||||||||||||||||||||||||||||||||||||||||||||||||||||
V.18:  6279 ctgaggggctggtggccggtagtgaagctgaaggaggcagaggacgtggagcgggaggcg  6338

V.1:   1443 caggaggctcaggctggcaagaagaagcgaaagcagaggaggaggaagggccggccagaa  1502
            ||||||||||||||||||||||||||||||||||||||||||||||||||||||||||||
V.18:  6339 caggaggctcaggctggcaagaagaagcgaaagcagaggaggaggaagggccggccagaa  6398

V.1:   1503 gacctggagttcacagacatgggtggcaatgtgtacatcctcacgggcaaggtggaggca  1562
            ||||||||||||||||||||||||||||||||||||||||||||||||||||||||||||
V.18:  6399 gacctggagttcacagacatgggtggcaatgtgtacatcctcacgggcaaggtggaggca  6458

V.1:   1563 gagtttgagctgctgactgtggaggaggccgagaaacggccagtggggaaggggcggaag  1622
            ||||||||||||||||||||||||||||||||||||||||||||||||||||||||||||
V.18:  6459 gagtttgagctgctgactgtggaggaggccgagaaacggccagtggggaaggggcggaag  6518
```

TABLE LIII(f)-continued

Nucleotide sequence alignment of 121P1F1 v.1 (SEQ ID NO: 363) and 158P3D2 v.18 (SEQ ID NO: 364)

```
V.1:   1623 cagccagagcctctggagaaacccagccgccccaaaacttccttcaactggtttgtgaac 1682
            ||||||||||||||||||||||||||||||||||||||||||||||||||||||||||||
V.18:  6519 cagccagagcctctggagaaacccagccgccccaaaacttccttcaactggtttgtgaac 6578

V.1:   1683 ccgctgaagacctttgtcttcttcatctggcgccggtactggcgcaccctggtgctgctg 1742
            ||||||||||||||||||||||||||||||||||||||||||||||||||||||||||||
V.18:  6579 ccgctgaagacctttgtcttcttcatctggcgccggtactggcgcaccctggtgctgctg 6638

V.1:   1743 ctactggtgctgctcaccgtcttcctcctcctggtcttctacaccatccctggccagatc 1802
            ||||||||||||||||||||||||||||||||||||||||||||||||||||||||||||
V.18:  6639 ctactggtgctgctcaccgtcttcctcctcctggtcttctacaccatccctggccagatc 6698

V.1:   1803 agccaggtcatcttccgtcccctccacaagtgactctcgctgaccttggacactcaccca 1862
            ||||||||||||||||||||||||||||||||||||||||||||||||||||||||||||
V.18:  6699 agccaggtcatcttccgtcccctccacaagtgactctcgctgaccttggacactcaccca 6758

V.1:   1863 gggtgccaacccttcaatgcctgctcctggaagtctttcttacccatgtgagctacccca 1922
            ||||||||||||||||||||||||||||||||||||||||||||||||||||||||||||
V.18:  6759 gggtgccaacccttcaatgcctgctcctggaagtctttcttacccatgtgagctacccca 6818

V.1:   1923 gagtctagtgcttcctctgaataaacctatcacagcc                        1959
            |||||||||||||||||||||||||||||||||||||
V.18:  6819 gagtctagtgcttcctctgaataaacctatcacagcc                           6
```

TABLE LIV(f)

Peptide sequences of protein coded by 158P3D2 v.18

(SEQ ID NO: 365)

```
MCKRRWHWPR SSWQNCAFWL RRHPGQPLVR SVPSWSSSCG WAWASKPRPA PLSCPRICCP   60
SPQPGCPPAY TGTVLEQTLS PLWDELLVFE QLIVDGRREH LQEEPPLVII NVFDHNKFGP  120
PVFLGRALAA PRVKLMEDPY QRPELQFFPL RKGPWAAGEL IAAFQLIELD YSGRLEPSVP  180
SEVEPQDLAP LVEPHSGRLS LPPNVCPVLR EFRVEVLFWG LRGLGRVHLL EVEQPQVVLE  240
VAGQGVESEV LASYRESPNF TELVRHLTVV FKDTAPLFHP QDLPEQPYLQ PPLSILVIER  300
RAFGHTVLVG SHIVPHMLRF TFRGHEDPPE EEGEMEETGD MMPKGPQGQK SLDPFLAEAG  360
ISRQLLKHNF DEDEMDDPGD SDGVNLISMV GEIQDQGEAE VKGTVSPKKA VATLKIYNRS  420
LKEEFNHFED WLNVFPLYRG QGGQDGGGEE EGSGHLVGKF KGSFLIYPES EAVLFSEPQI  480
SRGIPQNRPI KLLVRVYVVK ATNLAPADPN GKADPYVVVS AGRERQDTKE RYIPKQLNPI  540
FGEILELSIS LPAETELTVA VFDHDLVGSD DLIGETHIDL ENRFYSHHRA NCGLASQYEV  600
WVQQGPQEPF                                                        610
```

TABLE LV(f)

Amino acid sequence alignment of 121P1F1 v.1 and 158P3D2 v.18

No significant similarity.

SEQUENCE LISTING (365 sequences)

SEQ ID NO: 1 - DNA, 312 bp, Homo sapiens
  misc_feature 15, 103, 167: n = a, t, c, or g
  misc_feature 195, 196, 197, 198: n = a, t, c, or g
  misc_feature 266, 267, 274: n = a, t, c, or g
gatctcttcacatgnagattgacatctttcctcaagatgtgcctgctccacccccagttgacatcaagcctcggcagccaatcagctatgagctcagagttgncatctggaacacggaggatgtggttctggatgacgagaatccactcaccggagagatgtcgagngacatctatgtgaagagctgggtgaagnnnntggagcatgacaagcaggagacagacgttcacttcaactccctgactgtggaggggaacttcaattgnngctttgngctccgctttgactacctgcccacggagcgggaggatc

SEQ ID NO: 2 - DNA, 1994 bp, Homo sapiens
  CDS (849)...(1835)
tttttttatgaaacagtctcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatattttcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatatttttagtagagacagggtttcaccatgttgtccaggctggtcttgaacccctgacctcaagtgatccacccacctctgcctcccaaagtgctgggattacaggtgtgagccaccatgccaggccctcttaacctcttcaagtctgttttctcatctgcaaaacagaggtaataagatcagtatcttcttaatggaagcacctggactacatttttttcattcattgttatcataaatgaggactaacctgtctcccgttgggagttttgaacctagacctcatgtcttcatgacgtcatcactgccccaggcccagctgtgtccctacaccagccccagctgacgcatcttctttttctgcctgtagagatggttacaatgcctggcgtgatgcattctggccttcgcagatcctggcggggctgtgccaacgctgtggcctccctgcccctgaataccgagccggtgctgtcaaggtgggcagcaaagtcttcctgacaccaccggagaccctgcccccagggatctcttcacatgtggattgacatctttcctcaagatgtgcctgctccacccccagttgacatcaagcctcggcagccaatcagctatgagctcagagttgtcatctggaacacggaggatgtggttctggatgacgagaatccactcaccggagagatgtcgagtgacatctatgtgaagagctgggtgaaggggttggagcatgacaagcaggagacagacgttcacttcaactccctgactggggaggggaacttcaattggcgctttgtgttccgctttgactacctgcccacggagcgggaggtgagcgtctggcgcaggtctggaccctttgccctggaggaggcggagttccggcagcctgcagtgctggtcctgcaggtctgggactatgaccgcatctctgccaatgacttccttggatccctggagttgcagctaccagacatggtgcgtggggcccggggccccgagctctgctctgtgcagctggcccgcaatggggccgggccgaggtgcaatctgtttcgctgccgccgcctgaggggctggtggccggtagtgaagctgaaggaggcagaggacgtggagcgggaggcgcaggaggctcaggctggcaagaagaagcgaaagcagaggaggaggaagggccggccagaagacctggagttcacagacatgggtggcaatgtgtacatcctcacgggcaaggtggaggcagagtttgagctgctgactgtggaggaggccgagaaacggccagtggggaaggggcggaagcagccagagcctctggagaaacccagccgccccaaaacttccttcaactggtttgtgaacccgctgaagacctttgtcttcttcatctggcgccggtactggcgcaccctggtgctgctgctactggtgctgctcaccgtcttcctcctcctggtcttctacaccatccctggccagatcagccaggtcatcttccgtcccctccacaagtgactctcgctgaccttggacactcacccagggtgccaacccttcaatgcctgctcctggaagtctttcttacccatgtgagctaccccagagtctagtgcttcctctgaataaacctatcacagccacaaaaaaaaaaaaaaaaaaaaaaaaaaaaaaaaa

SEQ ID NO: 3 - protein, 328 aa, Homo sapiens [sequence omitted]

SEQ ID NO: 4 - DNA, 2918 bp, Homo sapiens
  CDS (117)...(827)
atcaaggccctgggctggaggaagacatcccagatccagaggagctcgactgggggtccaagtactatgcgtcgctgcaggagctccaggggcagcacaactttgatgaagatgaaatggatgatcctggagattcagatggggtcaacctcatttctatggttggggagatccaagaccagggtgaggctgaagtcaaaggcactgtgtccccaaaaaaagcagttgccaccctgaagatctacaacaggtccctggaggaagaatttaaccactttgaagactggctgaatgtgtttcctctgtaccgagggcaagggggccaggatggaggtggagaagaggaaggatctggacaccttgtgggcaagttcaagggctccttcctcatttaccctgaatcagaggcagtgttgttctctgagccccagatctctcgggggatcccacagaaccggcccatcaagctcctggtcagagtgtatgttgtaaaggctaccaacctggctcctgcagaccccaatggcaaagcagacccttacgtggtggtgagcgctggccgggagcggcaggacaccaaggaacgctacatccccaagcagctcaaccccatctttggagagatcctggagctaagcatctctctcccagctgagacggagctgacggtcgccgtatttgaacatgacctcgtgggttctgacgacctcatcggggagacccacattgatctggaaaaccgattctatagccaccacagagcaaactgtgggctggcctcccagtatgaagtgtgggtccagcagggcccacaggagccattctgagtttctggccaaacacattcaagctcacattcccttttgtgtctccagatcctatgatttcatggaaggggaccctcccacccaccgccactgccaaccaagacatagctcagtggtcaagacttgggcttgggagtcgggatcctgtaacgaatgtcacttgaccgctttctttttttatgaaacagtctcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatattttcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatatttttagtagagacagggtttcaccatgttgtccaggctggtcttgaacccctgacctcaagtgatccacccacctctgcctcccaaagtgctgggattacaggtgtgagccaccatgccaggccctcttaacctcttcaagtctgttttctcatctgcaaaacagaggtaataagatcagtatcttcttaatggaagcacctgggctacatttttttcattcattgttatcataaatgaggactaacctgtctcccgttgggagttttgaacctagacctcatgtcttcatgacgtcatcactgccccaggcccagctgtgtccctacaccagccccagctgacgcatcttctttttctgcctgtagagatggttacaatgcctggcgtgatgcattctggccttcgcagatcctggcggggctgtgccaacgctgtggcctccctgcccctgaataccgagccggtgctgtcaaggtgggcagcaaagtcttcctgacaccaccggagaccctgcccccagggatctcttcacatgtggattgacatctttcctcaagatgtgcctgctccacccccagttgacatcaagcctcggcagccaatcagctatgagctcagagttgtcatctggaacacggaggatgtggttctggatgacgagaatccactcaccggagagatgtcgagtgacatctatgtgaagagctgggtgaaggggttggagcatgacaagcaggagacagacgttcacttcaactccctgactggggaggggaacttcaattggcgctttgtgttccgctttgactacctgcccacggagcgggaggtgagcgtctggcgcaggtctggaccctttgccctggaggaggcggagttccggcagcctgcagtgctggtcctgcaggatccctggagttgcagctaccagacatggtgcgtggggcccggggccccgagctctgctctgtgcagctggcccgcaatggggccgggccgaggtgcaatctgtttcgctgccgccgcctgaggggctggtggccggtagtgaagctgaaggaggcagaggacgtggagcgggaggcgcaggaggctcaggctggcaagaagaagcgaaagcagaggaggaggaagggccggccagaagacctggagttcacagacatgggtggcaatgtgtacatcctcacgggcaaggtggaggcagagtttgagctgctgactgtggaggaggccgagaaacggccagtggggaaggggcggaagcagccagagcctctggagaaacccagccgccccaaaacttccttcaactggtttgtgaacccgctgaagacctttgtcttcttcatctggcgccggtactggcgcaccctggtgctgctgctactggtgctgctcaccgtcttcctcctcctggtcttctacaccatccctggccagatcagccaggtcatcttccgtcccctccacaagtgactctcgctgaccttggacactcacccagggtgccaacccttcaatgcctgctcctggaagtctttcttacccatgtgagctaccccagagtctagtgcttcctctgaataaacctatcacagcc

SEQ ID NO: 5 - protein, 236 aa, Homo sapiens
MDDPGDSDGVNLISMVGEIQDQGEAEVKGTVSPKKAVATLKIYNRSLEEEFNHFEDWLNVFPLYRGQGGQDGGGEEEGSGHLVGKFKGSFLIYPESEAVLFSEPQISRGIPQNRPIKLLVRVYVVKATNLAPADPNGKADPYVVVSAGRERQDTKERYIPKQLNPIFGEILELSISLPAETELTVAVFEHDLVGSDDLIGETHIDLENRFYSHHRANCGLASQYEVWVQQGPQEPF

SEQ ID NO: 6 - DNA, 2918 bp, Homo sapiens; identical to SEQ ID NO: 4
  CDS (2249)...(2794)

SEQ ID NO: 7 - protein, 181 aa, Homo sapiens [sequence omitted]

SEQ ID NO: 8 - DNA, 1994 bp, Homo sapiens
  CDS (849)...(1835)
tttttttatgaaacagtctcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatattttcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatatttttagtagagacagggtttcaccatgttgtccaggctggtcttgaacccctgacctcaagtgatccacccacctctgcctcccaaagtgctgggattacaggtgtgagccaccatgccaggccctcttaacctcttcaagtctgttttctcatctgcaaaacagaggtaataagatcagtatcttcttaatggaagcacctggactacatttttttcattcattgttatcataaatgaggactaacctgtctcccgttgggagttttgaacctagacctcatgtcttcatgacgtcatcactgccccaggcccagctgtgtccctacaccagccccagctgacgcatcttctttttctgcctgtagagatggttacaatgcctggcgtgatgcattctggccttcgcagatcctggcggggctgtgccaacgctgtggcctccctgcccctgaataccgagccggtgctgtcaaggtgggcagcaaagtcttcctgacaccaccggagaccctgcccccagggatctcttcacatgtggattgacatctttcctcaagatgtgcctgctccacccccagttgacatcaagcctcggcagccaatcagctatgagctcagagttgtcatctggaacacggaggatgtggttctggatgacgagaatccactcaccggagagatgtcgagtgacatctatgtgaagagctgggtgaaggggttggagcatgacaagcaggagacagacgttcacttcaactccctgactggggaggggaacttcaattggcgctttgtgttccgctttgactacctgcccacggagcgggaggtgagcgtccggcgcaggtctggaccctttgccctggaggaggcggagttccggcagcctgcagtgctggtcctgcaggtctgggactatgaccgcatctctgccaatgacttccttggatccctggagttgcagctaccagacatggtgcgtggggcccggggccccgagctctgctctgtgcagctggcccgcaatggggccgggccgaggtgcaatctgtttcgctgccgccgcctgaggggctggtggccggtagtgaagctgaaggaggcagaggacgtggagcgggaggcgcaggaggctcaggctggcaagaagaagcgaaagcagaggaggaggaagggccggccagaagacctggagttcacagacatgggtggcaatgtgtacatcctcacgggcaaggtggaggcagagtttgagctgctgactgtggaggaggccgagaaacggccagtggggaaggggcggaagcagccagagcctctggagaaacccagccgccccaaaacttccttcaactggtttgtgaacccgctgaagacctttgtcttcttcatctggcgccggtactggcgcaccctggtgctgctgctactggtgctgctcaccgtcttcctcctcctggtcttctacaccatccctggccagatcagccaggtcatcttccgtcccctccacaagtgactctcgctgaccttggacactcacccagggtgccaacccttcaatgcctgctcctggaagtctttcttacccatgtgagctaccccagagtctagtgcttcctctgaataaacctatcacagccacaaaaaaaaaaaaaaaaaaaaaaaaaaaaaaaaa

SEQ ID NO: 9 - protein, 328 aa, Homo sapiens [sequence omitted]

SEQ ID NO: 10 - DNA, 1994 bp, Homo sapiens
  CDS (849)...(1835)
tttttttatgaaacagtctcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatattttcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatatttttagtagagacagggtttcaccatgttgtccaggctggtcttgaacccctgacctcaagtgatccacccacctctgcctcccaaagtgctgggattacaggtgtgagccaccatgccaggccctcttaacctcttcaagtctgttttctcatctgcaaaacagaggtaataagatcagtatcttcttaatggaagcacctggactacatttttttcattcattgttatcataaatgaggactaacctgtctcccgttgggagttttgaacctagacctcatgtcttcatgacgtcatcactgccccaggcccagctgtgtccctacaccagccccagctgacgcatcttctttttctgcctgtagagatggttacaatgcctggcgtgatgcattctggccttcgcagatcctggcggggctgtgccaacgctgtggcctccctgcccctgaataccgagccggtgctgtcaaggtgggcagcaaagtcttcctgacaccaccggagaccctgcccccagggatctcttcacatgtggattgacatctttcctcaagatgtgcctgctccacccccagttgacatcaagcctcggcagccaatcagctatgagctcagagttgtcatctggaacacggaggatgtggttctggatgacgagaatccactcaccggagagatgtcgagtgacatctatgtgaagagctgggtgaaggggttggagcatgacaagcaggagacagacgttcacttcaactccctgactggggaggggaacttcaattggcgctttgtgttccgctttgactacctgcccacggagcgggaggtgagcatctggcgcaggtctggaccctttgccctggaggaggcggagttccggcagcctgcagtgctggtcctgcaggtctgggactatgaccgcatctctgccaatgacttccttggatccctggagttgcagctaccagacatggtgcgtggggcccggggccccgagctctgctctgtgcagctggcccgcaatggggccgggccgaggtgcaatctgtttcgctgccgccgcctgaggggctggtggccggtagtgaagctgaaggaggcagaggacgtggagcgggaggcgcaggaggctcaggctggcaagaagaagcgaaagcagaggaggaggaagggccggccagaagacctggagttcacagacatgggtggcaatgtgtacatcctcacgggcaaggtggaggcagagtttgagctgctgactgtggaggaggccgagaaacggccagtggggaaggggcggaagcagccagagcctctggagaaacccagccgccccaaaacttccttcaactggtttgtgaacccgctgaagacctttgtcttcttcatctggcgccggtactggcgcaccctggtgctgctgctactggtgctgctcaccgtcttcctcctcctggtcttctacaccatccctggccagatcagccaggtcatcttccgtcccctccacaagtgactctcgctgaccttggacactcacccagggtgccaacccttcaatgcctgctcctggaagtctttcttacccatgtgagctaccccagagtctagtgcttcctctgaataaacctatcacagccacaaaaaaaaaaaaaaaaaaaaaaaaaaaaaaaaa

SEQ ID NO: 11 - protein, 328 aa, Homo sapiens
MWIDIFPQDVPAPPPVDIKPRQPISYELRVVIWNTEDVVLDDENPLTGEMSSDIYVKSWVKGLEHDKQETDVHFNSLTGEGNFNWRFVFRFDYLPTEREVSIWRRSGPFALEEAEFRQPAVLVLQVWDYDRISANDFLGSLELQLPDMVRGARGPELCSVQLARNGAGPRCNLFRCRRLRGWWPVVKLKEAEDVEREAQEAQAGKKKRKQRRRKGRPEDLEFTDMGGNVYILTGKVEAEFELLTVEEAEKRPVGKGRKQPEPLEKPSRPKTSFNWFVNPLKTFVFFIWRRYWRTLVLLLLVLLTVFLLLVFYTIPGQISQVIFRPLHK

SEQ ID NO: 12 - DNA, 1993 bp, Homo sapiens
  CDS (849)...(1385)
tttttttatgaaacagtctcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatattttcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatatttttagtagagacagggtttcaccatgttgtccaggctggtcttgaacccctgacctcaagtgatccacccacctctgcctcccaaagtgctgggattacaggtgtgagccaccatgccaggccctcttaacctcttcaagtctgttttctcatctgcaaaacagaggtaataagatcagtatcttcttaatggaagcacctggactacatttttttcattcattgttatcataaatgaggactaacctgtctcccgttgggagttttgaacctagacctcatgtcttcatgacgtcatcactgccccaggcccagctgtgtccctacaccagccccagctgacgcatcttctttttctgcctgtagagatggttacaatgcctggcgtgatgcattctggccttcgcagatcctggcggggctgtgccaacgctgtggcctccctgcccctgaataccgagccggtgctgtcaaggtgggcagcaaagtcttcctgacaccaccggagaccctgcccccagggatctcttcacatgtggattgacatctttcctcaagatgtgcctgctccacccccagttgacatcaagcctcggcagccaatcagctatgagctcagagttgtcatctggaacacggaggatttggttctggatgacgagaatccactcaccggagagatgtcgagtgacatctatgtgaagagctgggtgaaggggttggagcatgacaagcaggagacagacgttcacttcaactccctgactggggaggggaacttcaattggcgctttgtgttccgctttgactacctgcccacggagcgggaggtgagcgtctggcgcaggtctggaccctttgccctggaggaggcggagttccggcagcctgcagtgctggtcctgcaggtctgggactataccgcatctctgccaatgacttccttggatccctggagttgcagctaccagacatggtgcgtggggcccggggccccgagctctgctctgtgcagctggcccgcaatggggccgggccgaggtgcaatctgtttcgctgccgccgcctgaggggctggtggccggtagtgaagctgaaggaggcagaggacgtggagcgggaggcgcaggaggctcaggctggcaagaagaagcgaaagcagaggaggaggaagggccggccagaagacctggagttcacagacatgggtggcaatgtgtacatcctcacgggcaaggtggaggcagagtttgagctgctgactgtggaggaggccgagaaacggccagtggggaaggggcggaagcagccagagcctctggagaaacccagccgccccaaaacttccttcaactggtttgtgaacccgctgaagacctttgtcttcttcatctggcgccggtactggcgcaccctggtgctgctgctactggtgctgctcaccgtcttcctcctcctggtcttctacaccatccctggccagatcagccaggtcatcttccgtcccctccacaagtgactctcgctgaccttggacactcacccagggtgccaacccttcaatgcctgctcctggaagtctttcttacccatgtgagctaccccagagtctagtgcttcctctgaataaacctatcacagccacaaaaaaaaaaaaaaaaaaaaaaaaaaaaaaaaa

SEQ ID NO: 13 - protein, 178 aa, Homo sapiens
MWIDIFPQDVPAPPPVDIKPRQPISYELRVVIWNTEDLVLDDENPLTGEMSSDIYVKSWVKGLEHDKQETDVHFNSLTGEGNFNWRFVFRFDYLPTEREVSVWRRSGPFALEEAEFRQPAVLVLQVWDYTASLPMTSLDPWSCSYQTWCVGPGAPSSALCSWPAMGPGRGAICFAAAA

SEQ ID NO: 14 - DNA, 1993 bp, Homo sapiens; identical to SEQ ID NO: 12
  CDS (1289)...(1834)

SEQ ID NO: 15 - protein, 181 aa, Homo sapiens [sequence omitted]

SEQ ID NO: 16 - DNA, 1994 bp, Homo sapiens
  CDS (849)...(1835)
tttttttatgaaacagtctcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatattttcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatatttttagtagagacagggtttcaccatgttgtccaggctggtcttgaacccctgacctcaagtgatccacccacctctgcctcccaaagtgctgggattacaggtgtgagccaccatgccaggccctcttaacctcttcaagtctgttttctcatctgcaaaacagaggtaataagatcagtatcttcttaatggaagcacctgggctacatttttttcattcattgttatcataaatgaggactaacctgtctcccgttgggagttttgaacctagacctcatgtcttcatgacgtcatcactgccccaggcccagctgtgtccctacaccagccccagctgacgcatcttctttttctgcctgtagagatggttacaatgcctggcgtgatgcattctggccttcgcagatcctggcggggctgtgccaacgctgtggcctccctgcccctgaataccgagccggtgctgtcaaggtgggcagcaaagtcttcctgacaccaccggagaccctgcccccagggatctcttcacatgtggattgacatctttcctcaagatgtgcctgctccacccccagttgacatcaagcctcggcagccaatcagctatgagctcagagttgtcatctggaacacggaggatgtggttctggatgacgagaatccactcaccggagagatgtcgagtgacatctatgtgaagagctgggtgaaggggttggagcatgacaagcaggagacagacgttcacttcaactccctgactggggaggggaacttcaattggcgctttgtgttccgctttgactacctgcccacggagcgggaggtgagcgtctggcgcaggtctggaccctttgccctggaggaggcggagttccggcagcctgcagtgctggtcctgcaggtctgggactatgaccgcatctctgccaatgacttccttggatccctggagttgcagctaccagacatggtgcgtggggcccggggccccgagctctgctctgtgcagctggcccgcaatggggccgggccgaggtgcaatctgtttcgctgccgccgcctgaggggctggtggccggtagtgaagctgaaggaggcagaggacgtggagcgggaggcgcaggaggctcaggctggcaagaagaagcgaaagcagaggaggaggaagggccggccagaagacctggagttcacagacatgggtggcaatgtgtacatcctcacgggcaaggtggaggcagagtttgagctgctgactgtggaggaggccgagaaacggccagtggggaaggggcggaagcagccagagcctctggagaaacccagccgccccaaaacttccttcaactggtttgtgaacccgctgaagacctttgtcttcttcatctggcgccggtactggcgcaccctggtgctgctgctactggtgctgctcaccgtcttcctcctcctggtcttctacaccatccctggccagatcagccaggtcatcttccgtcccctccacaagtgactctcgctgaccttggacactcacccagggtgccaacccttcaatgcctgctcctggaagtctttcttacccatgtgagctaccccagagtctagtgcttcctctgaataaacctatcacagccacaaaaaaaaaaaaaaaaaaaaaaaaaaaaaaaaa

SEQ ID NO: 17 - protein, 328 aa, Homo sapiens [sequence omitted]

SEQ ID NO: 18 - DNA, 1994 bp, Homo sapiens
  CDS (849)...(1835)
tttttttatgaaacagtctcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatattttcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatatttttagtagagacagggtttcaccatgttgtccaggctggtcttgaacccctgacctcaagtgatccacccacctctgcctcccaaagtgctgggattacaggtgtgagccaccatgccaggcccacttaacctcttcaagtctgttttctcatctgcaaaacagaggtaataagatcagtatcttcttaatggaagcacctggactacatttttttcattcattgttatcataaatgaggactaacctgtctcccgttgggagttttgaacctagacctcatgtcttcatgacgtcatcactgccccaggcccagctgtgtccctacaccagccccagctgacgcatcttctttttctgcctgtagagatggttacaatgcctggcgtgatgcattctggccttcgcagatcctggcggggctgtgccaacgctgtggcctccctgcccctgaataccgagccggtgctgtcaaggtgggcagcaaagtcttcctgacaccaccggagaccctgcccccagggatctcttcacatgtggattgacatctttcctcaagatgtgcctgctccacccccagttgacatcaagcctcggcagccaatcagctatgagctcagagttgtcatctggaacacggaggatgtggttctggatgacgagaatccactcaccggagagatgtcgagtgacatctatgtgaagagctgggtgaaggggttggagcatgacaagcaggagacagacgttcacttcaactccctgactggggaggggaacttcaattggcgctttgtgttccgctttgactacctgcccacggagcgggaggtgagcgtctggcgcaggtctggaccctttgccctggaggaggcggagttccggcagcctgcagtgctggtcctgcaggtctgggactatgaccgcatctctgccaatgacttccttggatccctggagttgcagctaccagacatggtgcgtggggcccggggccccgagctctgctctgtgcagctggcccgcaatggggccgggccgaggtgcaatctgtttcgctgccgccgcctgaggggctggtggccggtagtgaagctgaaggaggcagaggacgtggagcgggaggcgcaggaggctcaggctggcaagaagaagcgaaagcagaggaggaggaagggccggccagaagacctggagttcacagacatgggtggcaatgtgtacatcctcacgggcaaggtggaggcagagtttgagctgctgactgtggaggaggccgagaaacggccagtggggaaggggcggaagcagccagagcctctggagaaacccagccgccccaaaacttccttcaactggtttgtgaacccgctgaagacctttgtcttcttcatctggcgccggtactggcgcaccctggtgctgctgctactggtgctgctcaccgtcttcctcctcctggtcttctacaccatccctggccagatcagccaggtcatcttccgtcccctccacaagtgactctcgctgaccttggacactcacccagggtgccaacccttcaatgcctgctcctggaagtctttcttacccatgtgagctaccccagagtctagtgcttcctctgaataaacctatcacagccacaaaaaaaaaaaaaaaaaaaaaaaaaaaaaaaaa

SEQ ID NO: 19 - protein, 328 aa, Homo sapiens [sequence omitted]

SEQ ID NO: 20 - DNA, 1994 bp, Homo sapiens
  CDS (849)...(1835)
tttttttatgaaacagtctcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatattttcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatatttttagtagagacagggtttcaccatgttgtccaggctggtcttgaacccctgacctcaagtgatccacccacctctgcctcccaaagtgctgggattacaggtgtgagccaccatgccaggccctcttaacctcttcaagtctgttttctcatctgcaaaacagaggtaataagatcagtatcttcttaatggaagcacctggactacatttttttcattcattgttatcataaatgaggactaacctgtctcccgttgggagttttgaacctagacctcatgtcttcatgacgtcatcactgccccaggcccagctgtgtccctacaccagccccagctgacgcatcttctttttctgcctgtagagatggttacaatgcctggcgtgatgcattctggccttcgcagatcctggcggggctgtgccaacgctgtggcctccctgcccctgaataccgagccggtgctgtcaaggtgggcagcaaagtcttcctgacaccaccggagaccctgcccccagggatctcttcacatgtggattgacatctttcctcaagatgtgcctgctccacccccagttgacatcaagcctcggcagccaatcagctatgagctcagagttgtcatctggaacacggaggatgtggttctggacgacgagaatccactcaccggagagatgtcgagtgacatctatgtgaagagctgggtgaaggggttggagcatgacaagcaggagacagacgttcacttcaactccctgactggggaggggaacttcaattggcgctttgtgttccgctttgactacctgcccacggagcgggaggtgagcgtctggcgcaggtctggaccctttgccctggaggaggcggagttccggcagcctgcagtgctggtcctgcaggtctgggactatgaccgcatctctgccaatgacttccttggatccctggagttgcagctaccagacatggtgcgtggggcccggggccccgagctctgctctgtgcagctggcccgcaatggggccgggccgaggtgcaatctgtttcgctgccgccgcctgaggggctggtggccggtagtgaagctgaaggaggcagaggacgtggagcgggaggcgcaggaggctcaggctggcaagaagaagcgaaagcagaggaggaggaagggccggccagaagacctggagttcacagacatgggtggcaatgtgtacatcctcacgggcaaggtggaggcagagtttgagctgctgactgtggaggaggccgagaaacggccagtggggaaggggcggaagcagccagagcctctggagaaacccagccgccccaaaacttccttcaactggtttgtgaacccgctgaagacctttgtcttcttcatctggcgccggtactggcgcaccctggtgctgctgctactggtgctgctcaccgtcttcctcctcctggtcttctacaccatccctggccagatcagccaggtcatcttccgtcccctccacaagtgactctcgctgaccttggacactcacccagggtgccaacccttcaatgcctgctcctggaagtctttcttacccatgtgagctaccccagagtctagtgcttcctctgaataaacctatcacagccacaaaaaaaaaaaaaaaaaaaaaaaaaaaaaaaaa

SEQ ID NO: 21 - protein, 328 aa, Homo sapiens [sequence omitted]

SEQ ID NO: 22 - DNA, 7108 bp, Homo sapiens
  CDS (65)...(4246)
caggtgggcgggctggtgggcagaagggcagacgggcagaggaagtgccagtgccactgggaccatggctctgacggtaagcgtgcaacgactaacagggctgaccggcacccacgaccgacaagtgaagctcacctttcgaggctttacccagaaaacaagaaaaattcactgtggtccagaagcagatatcggtgagctgttccgatggccccactatggggctccactggctggggagtgtctgtctgtgcaggtggtcaactgcagccgtgtattcagccttaggcctctagggaccctggtgatctccctgcagcagctacagaatgctgggcatttggtgctacgggaagccctagtggatgagaatcttcaagtgtccccgatccaggtggagcttgacctgaagtaccagcccccagagggcgctactggagcctggtcagaggaggactttggggcacccatccaggacagcttcgagttaatcatccccaatgtgggcttccaggaactggagcctggggaggcccagctggagcggcgggcagtggctctaggccgcaggctagctcgaagtctaggccagcaggacgatgaagagaatgagctggagcttgagctggagcaggacctggatgatgagcctgacgtggaactttctggtgttatgttcagccccctcaagagccgcgccagggccctggcccatggggatcccttccaggtgtccagagctcaagacttccaggtgggagtcactgtgctggaagcccagaaactggtgggagtcaacattaacccctatgtggccgtgcaagtgggggggcagcgccgtgtgaccgccacacagcgtgggaccagttgccccttctacaatgagtacttcttgttcgaatttcatgacacgcggcttcgtctccaagacttgctgctggagatcacggtgagtggggtaggggtgaccagtgtccttcagagaaggggggatgagaaagctgcaggactaacaccaccttcccccaaggctttccattcgcagaccctcccctttatggccacccggataggcaccttcaggatggacctgggcatcatcttggaccagccagatggccagttctaccaaagatgggttccgctgcatgatccccgagacacccgcgccgggaccaagggtttcattaaggtcaccttgtccgtgagggcgcgcggggacctgccccctccaatgctacccccggccccagggcactgttcggacatcgagaagaacctgctcctgccgcgcggggtgcccgccgagaggccatgggcgcggctccgcgtgcgcctgtaccgcgccgaggggcttcccgcgctgcgcctggggctgctgggcagcctggtccgcgccctgcacgaccagcgcgtcctggtggagccctatgtgcgggtgtctttcctggggcaggagggcgagacgtcggtgagcgccgaggcggcggcgcccgaatggaacgagcagctgagcttcgtggagctcttcccgccgctgacgcgcagcctccgcctgcagctgcgggacgacgcgcccctggtcgacgcggcactcgctacgcacgtgccggacctgaggcggatctcccatccgggccgcgcggcggggtttaaccctaccttcggcccggcctgggtgcccctctatggctcgccccccggcgcggggctccgggatagtcttcaaggtctcaacgaaggcgttggccaaggcatttggttccgcggccgccttctgctggctgtgtccatgcaggtgttggaagggagagctgaacctgagcctccccaggcccagcaggggtccacgttgtcccggctcacccgaaagaagaaaaagaaagccagaagggatcagaccccaaaggcggttccgcagcacttggacgccagccccggtgccgaggggcctgagatcccccgtgccatggaggtggaggtggaggagctgctgccgctgccagagaatgtcctggcgccctgtgaagatttcctgcttttcggtgtgctcttcgaggccaccatgatcgaccccaccgtggcctcccagcccatcagcttcgagatctccattggtcgcgcaggccgtctggaggagcaattgggccgagggtccagggctggggagggaactgagggtgcagccgtggaggctcagcctctgctgggagccaggccagaggaggagaaagaggaggaagaactggggacccatgctcagcggcctgagcccatggacggcagtgggccatacttctgcttgcccctctgtcactgcaagccatgcatgcatgtgtggagttgctgggaggaccacacctggcgcctgcagagcagcaactgcgtgcgcaaagtggccgagaggctggaccaggggctgcaggaggttgagagactgcagcgcaagccggggcctggcgcctgtgcacagctcaagcaggcactggaagtactggtggctgggagcagacagttttgccacggtgccgagcgcaggacgatgacccggcccaatgccctggatcgatgccgagggaaactcctggtgcacagcctgaaccttttggctaagcaaggactgcgacttctacgcggcctgagacggcgcaatgtgcaaaagaaggtggcactggccaagaagctcctggcaaaactgcgctttctggctgaggagccccagccacccctccccgatgtgctggtctggatgctcagcgggcagcgccgtgtggcctgggcccggatccctgcccaggatgtgctgttctctgtggttgaggaggaacggggccgagactgtgggaagatccagagtctaatgctcacggcacccggggcagcccctggtgaggtctgtgccaagctggagctcttcctgcggctgggcctgggcaagcaagccaaggcctgcacctctgagctgcccccggatttgctgcccgagccctcagccgggctgccctccagcctacaccgggacgactttagctacttccaactccgggctcacttgtaccaggcccggggtgtgttggctgcagatgacagtggcctctcggacccctttgctcgagtcctcatctctacccagtgtcagaccacacgggtcctggagcagacgctgagccctctgtgggatgaactcctggtatttgagcagttgatcgtggatgggaggagggagcacctgcaggaggagcctccattagtgatcatcaatgtatttgaccacaataagtttggcccccccgtgttcctgggcagggcactggccgccccaagggtaaagctgatggaggacccataccaacgcccagagttgcagttcttccccctgaggaagggaccctgggcagccggagagctcattgccgcctttcaactcattgaactagactacagtggccgacttgagccctcagtgcccagtgaggtggagccccaggatctggcacccctggttgagccccactctggacgcctgtcccttccacccaacgtgtgcccagtgctcagggagttccgtgttgaggtgctgttctggggtcttaggggacttggtcgtgtgcatctgctcgaggtggagcagccccaggttgtactggaggtggctgggcaaggtgtggagtctgaggtcctggccagctaccgtgagagccccaatttcactgagcttgtcaggcatctgacagtggacttgccggagcagccttacttgcagcctccactcagcatcttggtgattgagcgccgggcctttggccacacagtccttgtgggttcccacattgtcccccacatgctgcgattcacatttcggggtcatgaggatcctcctgaggaggaaggagagatggaggagacaggggatatgatgcccaagggacctcaaggacagaagtccctggatcccttcttggctgaagcgggtatatccagacagctcctgaagcctcctctgaagaagctcccactaggaggcctcctaaatcaaggccctgggctggaggaagacatcccagatccagaggagctcgactgggggtccaagtactatgcgtcgctgcaggagctccaggggcagcacaactttgatgaagatgaaatggatgatcctggagattcagatggggtcaacctcatttctatggttggggagatccaagaccaggatctacaacaggtccctgaaggaagaatttaaccactttgaagactggctgaatgtgtttcctctgtaccgagggcaagggggccaggatggaggtggagaagaggaaggatctggacaccttgtgggcaagttcaagggctccttcctcatttaccctgaatcagaggcagtgttgttctctgagccccagatctcccgggggatcccacagaaccggcccatcaagctcctggtcagagtgtatgttgtaaaggctaccaacctggctcctgcagaccccaatggcaaagcagacccttacgtggtggtgagcgctggccgggagcggcaggacaccaaggaacgctacatccccaagcagctcaaccccatctttggagagatcctggagctaagcatctctctcccagctgagacggagctgacggtcgccgtatttgatcatgacctcgtgggttctgacgacctcatcggggagacccacattgatctggaaaaccgattctatagccaccacagagcaaactgtgggctggcctcccagtatgaagtgtgggtccagcagggcccacaggagccattctgagtttctggccaaacacattcaagctcacattcccttttgtgtctccagatcctatgatttcatggaaggggaccctcccacccaccgccactgccaaccaagacatagctcagtggtcaagacttgggcttgggagtcgggatcctgtaacgaatgtcacttgaccgctttctttttttatgaaacagtctcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatattttcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatatttttagtagagacagggtttcaccatgttgtccaggctggtcttgaacccctgacctcaagtgatccacccacctctgcctcccaaagtgctgggattacaggtgtgagccaccatgccaggccctcttaacctcttcaagtctgttttctcatctgcaaaacagaggtaataagatcagtatcttcttaatggaagcacctggactacatttttttcattcattgttatcataaatgaggactaacctgtctcccgttgggagttttgaacctagacctcatgtcttcatgacgtcatcactgccccaggcccagctgtgtccctacaccagccccagctgacgcatcttctttttctgcctgtagagatggttacaatgcctggcgtgatgcattctggccttcgcagatcctggcggggctgtgccaacgctgtggcctccctgcccctgaataccgagccggtgctgtcaaggtgggcagcaaagtcttcctgacaccaccggagaccctgcccccagggatctcttcacatgtggattgacatctttcctcaagatgtgcctgctccacccccagttgacatcaagcctcggcagccaatcagctatgagctcagagttgtcatctggaacacggaggatgtggttctggatgacgagaatccactcaccggagagatgtcgagtgacatctatgtgaagaggtaggctgctggccgggcggggcaacggcggtgcactagggggattgcaaatgggtgtgggccctcgggctgagtccagagccccgaccccaggccctccgtggtgctgagagcggggtgaggagtgggttctccatgtagctccagccctgacgctcacccaccccggccccagctgggtgaaggggttggagcatgacaagcaggagacagacgttcacttcaactccctgactggggaggggaacttcaattggcgctttgtgttccgctttgactacctgcccacggagcgggaggtgagcgtctggcgcaggtctggaccctttgccctggaggaggcggagttccggcagcctgcagtgctggtcctgcaggtctgggactatgaccgcatctctgccaatgacttccttggatccctggagttgcagctaccagacatggtgcgtggggcccggggccccgagctctgctctgtgcagctggcccgcaatggggccgggccgaggtgcaatctgtttcgctgccgccgcctgaggggctggtggccggtagtgaagctgaaggaggcagaggacgtggagcgggaggcgcaggaggctcaggctggcaagaagaagcgaaagcagaggaggaggaagggccggccagaagacctggagttcacagacatgggtggcaatgtgtacatcctcacgggcaaggtggaggcagagtttgagctgctgactgtggaggaggccgagaaacggccagtggggaaggggcggaagcagccagagcctctggagaaacccagccgccccaaaacttccttcaactggtttgtgaacccgctgaagacctttgtcttcttcatctggcgccggtactggcgcaccctggtgctgctgctactggtgctgctcaccgtcttcctcctcctggtcttctacaccatccctggccagatcagccaggtcatcttccgtcccctccacaagtgactctcgctgaccttggacactcacccagggtgccaacccttcaatgcctgctcctggaagtctttcttacccatgtgagctaccccagagtctagtgcttcctctgaataaacctatcacagcc

SEQ ID NO: 23 - protein, 1393 aa, Homo sapiens
MALTVSVQRLTGLTGTHDRQVKLTFRGFTQKTRKIHCGPEADIGELFRWPHYGAPLAGECLSVQVVNCSRVFSLRPLGTLVISLQQLQNAGHLVLREALVDENLQVSPIQVELDLKYQPPEGATGAWSEEDFGAPIQDSFELIIPNVGFQELEPGEAQLERRAVALGRRLARSLGQQDDEENELELELEQDLDDEPDVELSGVMFSPLKSRARALAHGDPFQVSRAQDFQVGVTVLEAQKLVGVNINPYVAVQVGGQRRVTATQRGTSCPFYNEYFLFEFHDTRLRLQDLLLEITVSGVGVTSVLQRRGDEKAAGLTPPSPKAFHSQTLPFMATRIGTFRMDLGIILDQPDGQFYQRWVPLHDPRDTRAGTKGFIKVTLSVRARGDLPPPMLPPAPGHCSDIEKNLLLPRGVPAERPWARLRVRLYRAEGLPALRLGLLGSLVRALHDQRVLVEPYVRVSFLGQEGETSVSAEAAAPEWNEQLSFVELFPPLTRSLRLQLRDDAPLVDAALATHVPDLRRISHPGRAAGFNPTFGPAWVPLYGSPPGAGLRDSLQGLNEGVGQGIWFRGRLLLAVSMQVLEGRAEPEPPQAQQGSTLSRLTRKKKKKARRDQTPKAVPQHLDASPGAEGPEIPRAMEVEVEELLPLPENVLAPCEDFLLFGVLFEATMIDPTVASQPISFEISIGRAGRLEEQLGRGSRAGEGTEGAAVEAQPLLGARPEEEKEEEELGTHAQRPEPMDGSGPYFCLPLCHCKPCMHVWSCWEDHTWRLQSSNCVRKVAERLDQGLQEVERLQRKPGPGACAQLKQALEVLVAGSRQFCHGAERRTMTRPNALDRCRGKLLVHSLNLLAKQGLRLLRGLRRRNVQKKVALAKKLLAKLRFLAEEPQPPLPDVLVWMLSGQRRVAWARIPAQDVLFSVVEEERGRDCGKIQSLMLTAPGAAPGEVCAKLELFLRLGLGKQAKACTSELPPDLLPEPSAGLPSSLHRDDFSYFQLRAHLYQARGVLAADDSGLSDPFARVLISTQCQTTRVLEQTLSPLWDELLVFEQLIVDGRREHLQEEPPLVIINVFDHNKFGPPVFLGRALAAPRVKLMEDPYQRPELQFFPLRKGPWAAGELIAAFQLIELDYSGRLEPSVPSEVEPQDLAPLVEPHSGRLSLPPNVCPVLREFRVEVLFWGLRGLGRVHLLEVEQPQVVLEVAGQGVESEVLASYRESPNFTELVRHLTVDLPEQPYLQPPLSILVIERRAFGHTVLVGSHIVPHMLRFTFRGHEDPPEEEGEMEETGDMMPKGPQGQKSLDPFLAEAGISRQLLKPPLKKLPLGGLLNQGPGLEEDIPDPEELDWGSKYYASLQELQGQHNFDEDEMDDPGDSDGVNLISMVGEIQDQDLQQVPEGRI

SEQ ID NO: 24 - DNA, 6303 bp, Homo sapiens
  CDS (65)...(3502)
caggtgggcgggctggtgggcagaagggcagacgggcagaggaagtgccagtgccactgggaccatggctctgacggtaagcgtgcaacgactaacagggctgaccggcacccacgaccgacaagtgaagctcacctttcgaggctttacccagaaaacaagaaaaattcactgtggtccagaagcagatatcggtgagctgttccgatggccccactatggggctccactggctggggagtgtctgtctgtgcaggtggtcaactgcagccgtgtattcagccttaggcctctagggaccctggtgatctccctgcagcagctacagaatgctgggcatttggtgctacgggaagccctagtggatgagaatcttcaagtgtccccgatccaggtggagcttgacctgaagtaccagcccccagagggcgctactggagcctggtcagaggaggactttggggcacccatccaggacagcttcgagttaatcatccccaatgtgggcttccaggaactggagcctggggaggcccagctggagcggcgggcagtggctctaggccgcaggctagctcgaagtctaggccagcaggacgatgaagagaatgagctggagcttgagctggagcaggacctggatgatgagcctgacgtggaactttctggtgttatgttcagccccctcaagagccgcgccagggccctggcccatggggatcccttccaggtgtccagagctcaagacttccaggtgggagtcactgtgctggaagcccagaaactggtgggagtcaacattaacccctatgtggccgtgcaagtgggggggcagcgccgtgtgaccgccacacagcgtgggaccagttgccccttctacaatgagtacttcttgttcgaatttcatgacacgcggcttcgtctccaagacttgctgctggagatcacggtgagtggggtaggggtgaccagtgtccttcagagaaggggggatgagaaagctgcaggactaacaccaccttcccccaaggctttccattcgcagaccctcccctttatggccacccggataggcaccttcaggatggacctgggcatcatcttggaccagccagatggccagttctaccaaagatgggttccgctgcatgatccccgagacacccgcgccgggaccaagggtttcattaaggtcaccttgtccgtgagggcgcgcggggacctgccccctccaatgctacccccggccccagggcactgttcggacatcgagaagaacctgctcctgccgcgcggggtgcccgccgagaggccatgggcgcggctccgcgtgcgcctgtaccgcgccgaggggcttcccgcgctgcgcctggggctgctgggcagcctggtccgcgccctgcacgaccagcgcgtcctggtggagccctatgtgcgggtgtctttcctggggcaggagggcgagacgtcggtgagcgccgaggcggcggcgcccgaatggaacgagcagctgagcttcgtggagctcttcccgccgctgacgcgcagcctccgcctgcagctgcgggacgacgcgcccctggtcgacgcggcactcgctacgcacgtgccggacctgaggcggatctcccatccgggccgcgcggcggggtttaaccctaccttcggcccggcctgggtgcccctctatggctcgccccccggcgcggggctccgggatagtcttcaaggtctcaacgaaggcgttggccaaggcatttggttccgcggccgccttctgctggctgtgtccatgcaggtgttggaagggagagctgaacctgagcctccccaggcccagcaggggtccacgttgtcccggctcacccgaaagaagaaaaagaaagccagaagggatcagaccccaaaggcggttccgcagcacttggacgccagccccggtgccgaggggcctgagatcccccgtgccatggaggtggaggtggaggagctgctgccgctgccagagaatgtcctggcgccctgtgaagatttcctgcttttcggtgtgctcttcgaggccaccatgatcgaccccaccgtggcctcccagcccatcagcttcgagatctccattggtcgcgcaggccgtctggaggagcaattgggccgagggtccagggctggggagggaactgagggtgcagccgtggaggctcagcctctgctgggagccaggccagaggaggagaaagaggaggaagaactggggacccatgctcagcggcctgagcccatggacggcagtgggccatacttctgcttgcccctctgtcactgcaagccatgcatgcatgtgtggagttgctgggaggaccacacctggcgcctgcagagcagcaactgcgtgcgcaaagtggccgagaggctggaccaggggctgcaggaggttgagagactgcagcgcaagccggggcctggcgcctgtgcacagctcaagcaggcactggaagtactggtggctgggagcagacagttttgccacggtgccgagcgcaggacgatgacccggcccaatgccctggatcgatgccgagggaaactcctggtgcacagcctgaaccttttggctaagcaaggactgcgacttctacgcggcctgagacggcgcaatgtgcaaaagaaggtggcactggccaagaagctcctggcaaaactgcgctttctggctgaggagcacaactttgatgaagatgaaatggatgatcctggagattcagatggggtcaacctcatttctatggttggggagatccaagaccagggtgaggctgaagtcaaaggcactgtgtccccaaaaaaagcagttgccaccctgaagatctacaacaggtccctgaaggaagaatttaaccactttgaagactggctgaatgtgtttcctctgtaccgagggcaagggggccaggatggaggtggagaagaggaaggatctggacaccttgtgggcaagttcaagggctccttcctcatttaccctgaatcagaggcagtgttgttctctgagccccagatctcccgggggatcccacagaaccggcccatcaagctcctggtcagagtgtatgttgtaaagctaagaaacctttgcaaaatccaaggtcatgaagacttttgcctgttttctgctgctaccaacctggctcctgcagaccccaatggcaaagcagacccttacgtggtggtgagcgctggccgggagcggcaggacaccaaggaacgctacatccccaagcagctcaaccccatctttggagagatcctggagctaagcatctctctcccagctgagacggagctgacggtcgccgtatttgatcatgacctcgtgggttctgacgacctcatcggggagacccacattgatctggaaaaccgattctatagccaccacagagcaaactgtgggctggcctcccagtatgaagtgtgggtccagcagggcccacaggagccattctgagtttctggccaaacacattcaagctcacattcccttttgtgtctccagatcctatgatttcatggaaggggaccctcccacccaccgccactgccaaccaagacatagctcagtggtcaagacttgggcttgggagtcgggatcctgtaacgaatgtcacttgaccgctttctttttttatgaaacagtctcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatattttcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatatttttagtagagacagggtttcaccatgttgtccaggctggtcttgaacccctgacctcaagtgatccacccacctctgcctcccaaagtgctgggattacaggtgtgagccaccatgccaggccctcttaacctcttcaagtctgttttctcatctgcaaaacagaggtaataagatcagtatcttcttaatggaagcacctggactacatttttttcattcattgttatcataaatgaggactaacctgtctcccgttgggagttttgaacctagacctcatgtcttcatgacgtcatcactgccccaggcccagctgtgtccctacaccagccccagctgacgcatcttctttttctgcctgtagagatggttacaatgcctggcgtgatgcattctggccttcgcagatcctggcggggctgtgccaacgctgtggcctccctgcccctgaataccgagccggtgctgtcaaggtgggcagcaaagtcttcctgacaccaccggagaccctgcccccagggatctcttcacatgtggattgacatctttcctcaagatgtgcctgctccacccccagttgacatcaagcctcggcagccaatcagctatgagctcagagttgtcatctggaacacggaggatgtggttctggatgacgagaatccactcaccggagagatgtcgagtgacatctatgtgaagaggtaggctgctggccgggcggggcaacggcggtgcactagggggattgcaaatgggtgtgggccctcgggctgagtccagagccccgaccccaggccctccgtggtgctgagagcggggtgaggagtgggttctccatgtagctccagccctgacgctcacccaccccggccccagctgggtgaaggggttggagcatgacaagcaggagacagacgttcacttcaactccctgactggggaggggaacttcaattggcgctttgtgttccgctttgactacctgcccacggagcgggaggtgagcgtctggcgcaggtctggaccctttgccctggaggaggcggagttccggcagcctgcagtgctggtcctgcaggtctgggactatgaccgcatctctgccaatgacttccttggtattacaatgcttagccttccccaccctcagcccctgcctccagccctcacctccgcccctgcctccagccctcacttccgtcccccagttccctactctgacccaaccttgaatcttgggattttggacccgaggtgtgaaacctttgctttctggcctaattactgagttaattaggcctagaccacagtaacctccattcccacccagagtctctgattcaactctgatttgaccctagcttgtcaccctgacaccgactccacagcctttggtccttggcactctgatcccgacccttggccctcttccactgggaagtagcaatgggtggaccgctgggctgtggtctgggtggtctatagctgtggcctgaccgcacactgcaacaactttcaatgccccaatttacaaccttggtgtgttgcctcctcacccctggcacaatgagactttgatcccatgcctaatctggtgtgctctggacttgcaggatccctggagttgcagctaccagacatggtgcgtggggcccggggccccgagctctgctctgtgcagctggcccgcaatggggccgggccgaggtgcaatctgtttcgctgccgccgcctgaggggctggtggccggtagtgaagctgaaggaggcagaggacgtggagcgggaggcgcaggaggctcaggctggcaagaagaagcgaaagcagaggaggaggaagggccggccagaagacctggagttcacagacatgggtggcaatgtgtacatcctcacgggcaaggtggaggcagagtttgagctgctgactgtggaggaggccgagaaacggccagtggggaaggggcggaagcagccagagcctctggagaaacccagccgccccaaaacttccttcaactggtttgtgaacccgctgaagacctttgtcttcttcatctggcgccggtactggcgcaccctggtgctgctgctactggtgctgctcaccgtcttcctcctcctggtcttctacaccatccctggccagatcagccaggtcatcttccgtcccctccacaagtgactctcgctgaccttggacactcacccagggtgccaacccttcaatgcctgctcctggaagtctttcttacccatgtgagctaccccagagtctagtgcttcctctgaataaacctatcacagcc

SEQ ID NO: 25 - protein, 1145 aa, Homo sapiens [sequence omitted]

SEQ ID NO: 26 - DNA, 6161 bp, Homo sapiens
  CDS (65)...(6037)
caggtgggcgggctggtgggcagaagggcagacgggcagaggaagtgccagtgccactgggaccatggctctgacggtaagcgtgcaacgactaacagggctgaccggcacccacgaccgacaagtgaagctcacctttcgaggctttacccagaaaacaagaaaaattcactgtggtccagaagcagatatcggtgagctgttccgatggccccactatggggctccactggctggggagtgtctgtctgtgcaggtggtcaactgcagccgtgtattcagccttaggcctctagggaccctggtgatctccctgcagcagctacagaatgctgggcatttggtgctacgggaagccctagtggatgagaatcttcaagtgtccccgatccaggtggagcttgacctgaagtaccagcccccagagggcgctactggagcctggtcagaggaggactttggggcacccatccaggacagcttcgagttaatcatccccaatgtgggcttccaggaactggagcctggggaggcccagctggagcggcgggcagtggctctaggccgcaggctagctcgaagtctaggccagcaggacgatgaagagaatgagctggagcttgagctggagcaggacctggatgatgagcctgacgtggaactttctggtgttatgttcagccccctcaagagccgcgccagggccctggcccatggggatcccttccaggtgtccagagctcaagacttccaggtgggagtcactgtgctggaagcccagaaactggtgggagtcaacattaacccctatgtggccgtgcaagtgggggggcagcgccgtgtgaccgccacacagcgtgggaccagttgccccttctacaatgagtacttcttgttcgaatttcatgacacgcggcttcgtctccaagacttgctgctggagatcacggtgagtggggtaggggtgaccagtgtccttcagagaaggggggatgagaaagctgcaggactaacaccaccttcccccaaggctttccattcgcagaccctcccctttatggccacccggataggcaccttcaggatggacctgggcatcatcttggaccagccagatggccagttctaccaaagatgggttccgctgcatgatccccgagacacccgcgccgggaccaagggtttcattaaggtcaccttgtccgtgagggcgcgcggggacctgccccctccaatgctacccccggccccagggcactgttcggacatcgagaagaacctgctcctgccgcgcggggtgcccgccgagaggccatgggcgcggctccgcgtgcgcctgtaccgcgccgaggggcttcccgcgctgcgcctggggctgctgggcagcctggtccgcgccctgcacgaccagcgcgtcctggtggagccctatgtgcgggtgtctttcctggggcaggagggcgagacgtcggtgagcgccgaggcggcggcgcccgaatggaacgagcagctgagcttcgtggagctcttcccgccgctgacgcgcagcctccgcctgcagctgcgggacgacgcgcccctggtcgacgcggcactcgctacgcacgtgccggacctgaggcggatctcccatccgggccgcgcggcggggtttaaccctaccttcggcccggcctgggtgcccctctatggctcgccccccggcgcggggctccgggatagtcttcaaggtctcaacgaaggcgttggccaaggcatttggttccgcggccgccttctgctggctgtgtccatgcaggtgttggaagggagagctgaacctgagcctccccaggcccagcaggggtccacgttgtcccggctcacccgaaagaagaaaaagaaagccagaagggatcagaccccaaaggcggttccgcagcacttggacgccagccccggtgccgaggggcctgagatcccccgtgccatggaggtggaggtggaggagctgctgccgctgccagagaatgtcctggcgccctgtgaagatttcctgcttttcggtgtgctcttcgaggccaccatgatcgaccccaccgtggcctcccagcccatcagcttcgagatctccattggtcgcgcaggccgtctggaggagcaattgggccgagggtccagggctggggagggaactgagggtgcagccgtggaggctcagcctctgctgggagccaggccagaggaggagaaagaggaggaagaactggggacccatgctcagcggcctgagcccatggacggcagtgggccatacttctgcttgcccctctgtcactgcaagccatgcatgcatgtgtggagttgctgggaggaccacacctggcgcctgcagagcagcaactgcgtgcgcaaagtggccgagaggctggaccaggggctgcaggaggttgagagactgcagcgcaagccggggcctggcgcctgtgcacagctcaagcaggcactggaagtactggtggctgggagcagacagttttgccacggtgccgagcgcaggacgatgacccggcccaatgccctggatcgatgccgagggaaactcctggtgcacagcctgaaccttttggctaagcaaggactgcgacttctacgcggcctgagacggcgcaatgtgcaaaagaaggtggcactggccaagaagctcctggcaaaactgcgctttctggctgaggagccccagccacccctccccgatgtgctggtctggatgctcagcgggcagcgccgtgtggcctgggcccggatccctgcccaggatgtgctgttctctgtggttgaggaggaacggggccgagactgtgggaagatccagagtctaatgctcacggcacccggggcagcccctggtgaggtctgtgccaagctggagctcttcctgcggctgggcctgggcaagcaagccaaggcctgcacctctgagctgcccccggatttgctgcccgagccctcagccgggctgccctccagcctacaccgggacgactttagctacttccaactccgggctcacttgtaccaggcccggggtgtgttggctgcagatgacagtggcctctcggacccctttgctcgagtcctcatctctacccagtgtcagaccacacgggtcctggagcagacgctgagccctctgtgggatgaactcctggtatttgagcagttgatcgtggatgggaggagggagcacctgcaggaggagcctccattagtgatcatcaatgtatttgaccacaataagtttggcccccccgtgttcctgggcagggcactggccgccccaagggtaaagctgatggaggacccataccaacgcccagagttgcagttcttccccctgaggaagggaccctgggcagccggagagctcattgccgcctttcaactcattgaactagactacagtggccgacttgagccctcagtgcccagtgaggtggagccccaggatctggcacccctggttgagccccactctggacgcctgtcccttccacccaacgtgtgcccagtgctcagggagttccgtgttgaggtgctgttctggggtcttaggggacttggtcgtgtgcatctgctcgaggtggagcagccccaggttgtactggaggtggctgggcaaggtgtggagtctgaggtcctggccagctaccgtgagagccccaatttcactgagcttgtcaggcatctgacagtggtcttcaaagacacagctcctctcttccacccccaggacttgccggagcagccttacttgcagcctccactcagcatcttggtgattgagcgccgggcctttggccacacagtccttgtgggttcccacattgtcccccacatgctgcgattcacatttcggggtcatgaggatcctcctgaggaggaaggagagatggaggagacaggggatatgatgcccaagggacctcaaggacagaagtccctggatcccttcttggctgaagcgggtatatccagacagctcctgaagcctcctctgaagaagctcccactaggaggcctcctaaatcaaggccctgggctggaggaagacatcccagatccagaggagctcgactgggggtccaagtactatgcgtcgctgcaggagctccaggggcagcacaactttgatgaagatgaaatggatgatcctggagattcagatggggtcaacctcatttctatggttggggagatccaagaccagggtgaggctgaagtcaaaggcactgtgtccccaaaaaaagcagttgccaccctgaagatctacaacaggtccctgaaggaagaatttaaccactttgaagactggctgaatgtgtttcctctgtaccgagggcaagggggccaggatggaggtggagaagaggaaggatctggacaccttgtgggcaagttcaagggctccttcctcatttaccctgaatcagaggcagtgttgttctctgagccccagatctcccgggggatcccacagaaccggcccatcaagctcctggtcagagtgtatgttgtaaaggctaccaacctggctcctgcagaccccaatggcaaagcagacccttacgtggtggtgagcgctggccgggagcggcaggacaccaaggaacgctacatccccaagcagctcaaccccatctttggagagatcctggagctaagcatctctctcccagctgagacggagctgacggtcgccgtatttgatcatgacctcgtgggttctgacgacctcatcggggagacccacattgatctggaaaaccgattctatagccaccacagagcaaactgtgggctggcctcccagtatgaagtagatggttacaatgcctggcgtgatgcattctggccttcgcagatcctggcggggctgtgccaacgctgtggcctccctgcccctgaataccgagccggtgctgtcaaggtgggcagcaaagtcttcctgacaccaccggagaccctgcccccagtggcgagcggggaccctgaagaggcccaggcattgcttgtgctgcggcgctggcaggaaatgccgggttttgggatccagctggtacccgagcatgtagaaaccaggcctctctaccatccccacagcccagggctgctacagggatctcttcacatgtggattgacatctttcctcaagatgtgcctgctccacccccagttgacatcaagcctcggcagccaatcagctatgagctcagagttgtcatctggaacacggaggatgtggttctggatgacgagaatccactcaccggagagatgtcgagtgacatctatgtgaagagctgggtgaaggggttggagcatgacaagcaggagacagacgttcacttcaactccctgactggggaggggaacttcaattggcgctttgtgttccgctttgactacctgcccacggagcgggaggtgagcgtctggcgcaggtctggaccctttgccctggaggaggcggagttccggcagcctgcagtgctggtcctgcaggtctgggactatgaccgcatctctgccaatgacttccttggatccctggagttgcagctaccagacatggtgcgtggggcccggggccccgagctctgctctgtgcagctggcccgcaatggggccgggccgaggtgcaatctgtttcgctgccgccgcctgaggggctggtggccggtagtgaagctgaaggaggcagaggacggcaaggtggaggcagagtttgagctgctgactgtggaggaggccgagaaacggccagtggggaaggggcggaagcagccagagcctctggagaaacccagccgccccaaaacttccttcaactggtttgtgaacccgctgaagacctttgtcttcttcatctggcgccggtactggcgcaccctggtgctgctgctactggtgctgctcaccgtcttcctcctcctggtcttctacaccatccctggccagatcagccaggtcatcttccgtcccctccacaagtgactctcgctgaccttggacactcacccagggtgccaacccttcaatgcctgctcctggaagtctttcttacccatgtgagctaccccagagtctagtgcttcctctgaataaacctatcacagcc

SEQ ID NO: 27 - protein, 1990 aa, Homo sapiens
MALTVSVQRLTGLTGTHDRQVKLTFRGFTQKTRKIHCGPEADIGELFRWPHYGAPLAGECLSVQVVNCSRVFSLRPLGTLVISLQQLQNAGHLVLREALVDENLQVSPIQVELDLKYQPPEGATGAWSEEDFGAPIQDSFELIIPNVGFQELEPGEAQLERRAVALGRRLARSLGQQDDEENELELELEQDLDDEPDVELSGVMFSPLKSRARALAHGDPFQVSRAQDFQVGVTVLEAQKLVGVNINPYVAVQVGGQRRVTATQRGTSCPFYNEYFLFEFHDTRLRLQDLLLEITVSGVGVTSVLQRRGDEKAAGLTPPSPKAFHSQTLPFMATRIGTFRMDLGIILDQPDGQFYQRWVPLHDPRDTRAGTKGFIKVTLSVRARGDLPPPMLPPAPGHCSDIEKNLLLPRGVPAERPWARLRVRLYRAEGLPALRLGLLGSLVRALHDQRVLVEPYVRVSFLGQEGETSVSAEAAAPEWNEQLSFVELFPPLTRSLRLQLRDDAPLVDAALATHVPDLRRISHPGRAAGFNPTFGPAWVPLYGSPPGAGLRDSLQGLNEGVGQGIWFRGRLLLAVSMQVLEGRAEPEPPQAQQGSTLSRLTRKKKKKARRDQTPKAVPQHLDASPGAEGPEIPRAMEVEVEELLPLPENVLAPCEDFLLFGVLFEATMIDPTVASQPISFEISIGRAGRLEEQLGRGSRAGEGTEGAAVEAQPLLGARPEEEKEEEELGTHAQRPEPMDGSGPYFCLPLCHCKPCMHVWSCWEDHTWRLQSSNCVRKVAERLDQGLQEVERLQRKPGPGACAQLKQALEVLVAGSRQFCHGAERRTMTRPNALDRCRGKLLVHSLNLLAKQGLRLLRGLRRRNVQKKVALAKKLLAKLRFLAEEPQPPLPDVLVWMLSGQRRVAWARIPAQDVLFSVVEEERGRDCGKIQSLMLTAPGAAPGEVCAKLELFLRLGLGKQAKACTSELPPDLLPEPSAGLPSSLHRDDFSYFQLRAHLYQARGVLAADDSGLSDPFARVLISTQCQTTRVLEQTLSPLWDELLVFEQLIVDGRREHLQEEPPLVIINVFDHNKFGPPVFLGRALAAPRVKLMEDPYQRPELQFFPLRKGPWAAGELIAAFQLIELDYSGRLEPSVPSEVEPQDLAPLVEPHSGRLSLPPNVCPVLREFRVEVLFWGLRGLGRVHLLEVEQPQVVLEVAGQGVESEVLASYRESPNFTELVRHLTVVFKDTAPLFHPQDLPEQPYLQPPLSILVIERRAFGHTVLVGSHIVPHMLRFTFRGHEDPPEEEGEMEETGDMMPKGPQGQKSLDPFLAEAGISRQLLKPPLKKLPLGGLLNQGPGLEEDIPDPEELDWGSKYYASLQELQGQHNFDEDEMDDPGDSDGVNLISMVGEIQDQGEAEVKGTVSPKKAVATLKIYNRSLKEEFNHFEDWLNVFPLYRGQGGQDGGGEEEGSGHLVGKFKGSFLIYPESEAVLFSEPQISRGIPQNRPIKLLVRVYVVKATNLAPADPNGKADPYVVVSAGRERQDTKERYIPKQLNPIFGEILELSISLPAETELTVAVFDHDLVGSDDLIGETHIDLENRFYSHHRANCGLASQYEVDGYNAWRDAFWPSQILAGLCQRCGLPAPEYRAGAVKVGSKVFLTPPETLPPVASGDPEEAQALLVLRRWQEMPGFGIQLVPEHVETRPLYHPHSPGLLQGSLHMWIDIFPQDVPAPPPVDIKPRQPISYELRVVIWNTEDVVLDDENPLTGEMSSDIYVKSWVKGLEHDKQETDVHFNSLTGEGNFNWRFVFRFDYLPTEREVSVWRRSGPFALEEAEFRQPAVLVLQVWDYDRISANDFLGSLELQLPDMVRGARGPELCSVQLARNGAGPRCNLFRCRRLRGWWPVVKLKEAEDGKVEAEFELLTVEEAEKRPVGKGRKQPEPLEKPSRPKTSFNWFVNPLKTFVFFIWRRYWRTLVLLLLVLLTVFLLLVFYTIPGQISQVIFRPLHK

SEQ ID NO: 28 - DNA, 6299 bp, Homo sapiens
  CDS (65)...(6175)
caggtgggcgggctggtgggcagaagggcagacgggcagaggaagtgccagtgccactgggaccatggctctgacggtaagcgtgcaacgactaacagggctgaccggcacccacgaccgacaagtgaagctcacctttcgaggctttacccagaaaacaagaaaaattcactgtggtccagaagcagatatcggtgagctgttccgatggccccactatggggctccactggctggggagtgtctgtctgtgcaggtggtcaactgcagccgtgtattcagccttaggcctctagggaccctggtgatctccctgcagcagctacagaatgctgggcatttggtgctacgggaagccctagtggatgagaatcttcaagtgtccccgatccaggtggagcttgacctgaagtaccagcccccagagggcgctactggagcctggtcagaggaggactttggggcacccatccaggacagcttcgagttaatcatccccaatgtgggcttccaggaactggagcctggggaggcccagctggagcggcgggcagtggctctaggccgcaggctagctcgaagtctaggccagcaggacgatgaagagaatgagctggagcttgagctggagcaggacctggatgatgagcctgacgtggaactttctggtgttatgttcagccccctcaagagccgcgccagggccctggcccatggggatcccttccaggtgtccagagctcaagacttccaggtgggagtcactgtgctggaagcccagaaactggtgggagtcaacattaacccctatgtggccgtgcaagtgggggggcagcgccgtgtgaccgccacacagcgtgggaccagttgccccttctacaatgagtacttcttgttcgaatttcatgacacgcggcttcgtctccaagacttgctgctggagatcacggtgagtggggtaggggtgaccagtgtccttcagagaaggggggatgagaaagctgcaggactaacaccaccttcccccaaggctttccattcgcagaccctcccctttatggccacccggataggcaccttcaggatggacctgggcatcatcttggaccagccagatggccagttctaccaaagatgggttccgctgcatgatccccgagacacccgcgccgggaccaagggtttcattaaggtcaccttgtccgtgagggcgcgcggggacctgccccctccaatgctacccccggccccagggcactgttcggacatcgagaagaacctgctcctgccgcgcggggtgcccgccgagaggccatgggcgcggctccgcgtgcgcctgtaccgcgccgaggggcttcccgcgctgcgcctggggctgctgggcagcctggtccgcgccctgcacgaccagcgcgtcctggtggagccctatgtgcgggtgtctttcctggggcaggagggcgagacgtcggtgagcgccgaggcggcggcgcccgaatggaacgagcagctgagcttcgtggagctcttcccgccgctgacgcgcagcctccgcctgcagctgcgggacgacgcgcccctggtcgacgcggcactcgctacgcacgtgccggacctgaggcggatctcccatccgggccgcgcggcggggtttaaccctaccttcggcccggcctgggtgcccctctatggctcgccccccggcgcggggctccgggatagtcttcaaggtctcaacgaaggcgttggccaaggcatttggttccgcggccgccttctgctggctgtgtccatgcaggtgttggaagggagagctgaacctgagcctccccaggcccagcaggggtccacgttgtcccggctcacccgaaagaagaaaaagaaagccagaagggatcagaccccaaaggcggttccgcagcacttggacgccagccccggtgccgaggggcctgagatcccccgtgccatggaggtggaggtggaggagctgctgccgctgccagagaatgtcctggcgccctgtgaagatttcctgcttttcggtgtgctcttcgaggccaccatgatcgaccccaccgtggcctcccagcccatcagcttcgagatctccattggtcgcgcaggccgtctggaggagcaattgggccgagggtccagggctggggagggaactgagggtgcagccgtggaggctcagcctctgctgggagccaggccagaggaggagaaagaggaggaagaactggggacccatgctcagcggcctgagcccatggacggcagtgggccatacttctgcttgcccctctgtcactgcaagccatgcatgcatgtgtggagttgctgggaggaccacacctggcgcctgcagagcagcaactgcgtgcgcaaagtggccgagaggctggaccaggggctgcaggaggttgagagactgcagcgcaagccggggcctggcgcctgtgcacagctcaagcaggcactggaagtactggtggctgggagcagacagttttgccacggtgccgagcgcaggacgatgacccggcccaatgccctggatcgatgccgagggaaactcctggtgcacagcctgaaccttttggctaagcaaggactgcgacttctacgcggcctgagacggcgcaatgtgcaaaagaaggtggcactggccaagaagctcctggcaaaactgcgctttctggctgaggagccccagccacccctccccgatgtgctggtctggatgctcagcgggcagcgccgtgtggcctgggcccggatccctgcccaggatgtgctgttctctgtggttgaggaggaacggggccgagactgtgggaagatccagagtctaatgctcacggcacccggggcagcccctggtgaggtctgtgccaagctggagctcttcctgcggctgggcctgggcaagcaagccaaggcctgcacctctgagctgcccccggatttgctgcccgagccctcagccgggctgccctccagcctacaccgggacgactttagctacttccaactccgggctcacttgtaccaggcccggggtgtgttggctgcagatgacagtggcctctcggacccctttgctcgagtcctcatctctacccagtgtcagaccacacgggtcctggagcagacgctgagccctctgtgggatgaactcctggtatttgagcagttgatcgtggatgggaggagggagcacctgcaggaggagcctccattagtgatcatcaatgtatttgaccacaataagtttggcccccccgtgttcctgggcagggcactggccgccccaagggtaaagctgatggaggacccataccaacgcccagagttgcagttcttccccctgaggaagggaccctgggcagccggagagctcattgccgcctttcaactcattgaactagactacagtggccgacttgagccctcagtgcccagtgaggtggagccccaggatctggcacccctggttgagccccactctggacgcctgtcccttccacccaacgtgtgcccagtgctcagggagttccgtgttgaggtgctgttctggggtcttaggggacttggtcgtgtgcatctgctcgaggtggagcagccccaggttgtactggaggtggctgggcaaggtgtggagtctgaggtcctggccagctaccgtgagagccccaatttcactgagcttgtcaggcatctgacagtggtcttcaaagacacagctcctctcttccacccccaggacttgccggagcagccttacttgcagcctccactcagcatcttggtgattgagcgccgggcctttggccacacagtccttgtgggttcccacattgtcccccacatgctgcgattcacatttcggggtcatgaggatcctcctgaggaggaaggagagatggaggagacaggggatatgatgcccaagggacctcaaggacagaagtccctggatcccttcttggctgaagcgggtatatccagacagctcctgaagcctcctctgaagaagctcccactaggaggcctcctaaatcaaggccctgggctggaggaagacatcccagatccagaggagctcgactgggggtccaagtactatgcgtcgctgcaggagctccaggggcagcacaactttgatgaagatgaaatggatgatcctggagattcagatggggtcaacctcatttctatggttggggagatccaagaccagggtgaggctgaagtcaaaggcactgtgtccccaaaaaaagcagttgccaccctgaagatctacaacaggtccctgaaggaagaatttaaccactttgaagactggctgaatgtgtttcctctgtaccgagggcaagggggccaggatggaggtggagaagaggaaggatctggacaccttgtgggcaagttcaagggctccttcctcatttaccctgaatcagaggcagtgttgttctctgagccccagatctcccgggggatcccacagaaccggcccatcaagctcctggtcagagtgtatgttgtaaaggctaccaacctggctcctgcagaccccaatggcaaagcagacccttacgtggtggtgagcgctggccgggagcggcaggacaccaaggaacgctacatccccaagcagctcaaccccatctttggagagatcctggagctaagcatctctctcccagctgagacggagctgacggtcgccgtatttgatcatgacctcgtgggttctgacgacctcatcggggagacccacattgatctggaaaaccgattctatagccaccacagagcaaactgtgggctggcctcccagtatgaagtagatggttacaatgcctggcgtgatgcattctggccttcgcagatcctggcggggctgtgccaacgctgtggcctccctgcccctgaataccgagccggtgctgtcaaggtgggcagcaaagtcttcctgacaccaccggagaccctgcccccaggcagcagcagccccacagtggcgagcggggaccctgaagaggcccaggcattgcttgtgctgcggcgctggcaggaaatgccgggttttgggatccagctggtacccgagcatgtagaaaccaggcctctctaccatccccacagcccagggctgctacagggatctcttcacatgtggattgacatctttcctcaagatgtgcctgctccacccccagttgacatcaagcctcggcagccaatcagctatgagctcagagttgtcatctggaacacggaggatgtggttctggatgacgagaatccactcaccggagagatgtcgagtgacatctatgtgaagagctgggtgaaggggttggagcatgacaagcaggagacagacgttcacttcaactccctgactggggaggggaacttcaattggcgctttgtgttccgctttgactacctgcccacggagcgggaggtgagcgtctggcgcaggtctggaccctttgccctggaggaggcggagttccggcagcctgcagtgctggtcctgcaggtctgggactatgaccgcatctctgccaatgacttccttggatccctggagttgcagctaccagacatggtgcgtggggcccggggccccgagctctgctctgtgcagctggcccgcaatggggccgggccgaggtgcaatctgtttcgctgccgccgcctgaggggctggtggccggtagtgaagctgaaggaggcagaggacgtggagcgggaggcgcaggaggctcaggctggcaagaagaagcgaaagcagaggaggaggaagggccggccagaagacctggagttcacagacatgggtggcaatgtgtacatcctcacgggcaaggtggaggcagagtttgagctgctgactgtggaggaggccgagaaacggccagtggggaaggggcggaagcagccagagcctctggagaaacccagccgccccaaaacttccttcaactggtttgtgaacccgctgaagacctttgtcttcttcatctggcgccggtactggcgcaccctggtgctgctgctactggtgctgctcaccgtcttcctcctcctggtcttctacaccatccctggccagatcagccaggtcatcttccgtcccctccacaagtgactctcgctgaccttggacactcacccagggtgccaacccttcaatgcctgctcctggaagtctttcttacccatgtgagctaccccagagtctagtgcttcctctgaataaacctatcacagcc

SEQ ID NO: 29 - protein, 2036 aa, Homo sapiens
MALTVSVQRLTGLTGTHDRQVKLTFRGFTQKTRKIHCGPEADIGELFRWPHYGAPLAGECLSVQVVNCSRVFSLRPLGTLVISLQQLQNAGHLVLREALVDENLQVSPIQVELDLKYQPPEGATGAWSEEDFGAPIQDSFELIIPNVGFQELEPGEAQLERRAVALGRRLARSLGQQDDEENELELELEQDLDDEPDVELSGVMFSPLKSRARALAHGDPFQVSRAQDFQVGVTVLEAQKLVGVNINPYVAVQVGGQRRVTATQRGTSCPFYNEYFLFEFHDTRLRLQDLLLEITVSGVGVTSVLQRRGDEKAAGLTPPSPKAFHSQTLPFMATRIGTFRMDLGIILDQPDGQFYQRWVPLHDPRDTRAGTKGFIKVTLSVRARGDLPPPMLPPAPGHCSDIEKNLLLPRGVPAERPWARLRVRLYRAEGLPALRLGLLGSLVRALHDQRVLVEPYVRVSFLGQEGETSVSAEAAAPEWNEQLSFVELFPPLTRSLRLQLRDDAPLVDAALATHVPDLRRISHPGRAAGFNPTFGPAWVPLYGSPPGAGLRDSLQGLNEGVGQGIWFRGRLLLAVSMQVLEGRAEPEPPQAQQGSTLSRLTRKKKKKARRDQTPKAVPQHLDASPGAEGPEIPRAMEVEVEELLPLPENVLAPCEDFLLFGVLFEATMIDPTVASQPISFEISIGRAGRLEEQLGRGSRAGEGTEGAAVEAQPLLGARPEEEKEEEELGTHAQRPEPMDGSGPYFCLPLCHCKPCMHVWSCWEDHTWRLQSSNCVRKVAERLDQGLQEVERLQRKPGPGACAQLKQALEVLVAGSRQFCHGAERRTMTRPNALDRCRGKLLVHSLNLLAKQGLRLLRGLRRRNVQKKVALAKKLLAKLRFLAEEPQPPLPDVLVWMLSGQRRVAWARIPAQDVLFSVVEEERGRDCGKIQSLMLTAPGAAPGEVCAKLELFLRLGLGKQAKACTSELPPDLLPEPSAGLPSSLHRDDFSYFQLRAHLYQARGVLAADDSGLSDPFARVLISTQCQTTRVLEQTLSPLWDELLVFEQLIVDGRREHLQEEPPLVIINVFDHNKFGPPVFLGRALAAPRVKLMEDPYQRPELQFFPLRKGPWAAGELIAAFQLIELDYSGRLEPSVPSEVEPQDLAPLVEPHSGRLSLPPNVCPVLREFRVEVLFWGLRGLGRVHLLEVEQPQVVLEVAGQGVESEVLASYRESPNFTELVRHLTVVFKDTAPLFHPQDLPEQPYLQPPLSILVIERRAFGHTVLVGSHIVPHMLRFTFRGHEDPPEEEGEMEETGDMMPKGPQGQKSLDPFLAEAGISRQLLKPPLKKLPLGGLLNQGPGLEEDIPDPEELDWGSKYYASLQELQGQHNFDEDEMDDPGDSDGVNLISMVGEIQDQGEAEVKGTVSPKKAVATLKIYNRSLKEEFNHFEDWLNVFPLYRGQGGQDGGGEEEGSGHLVGKFKGSFLIYPESEAVLFSEPQISRGIPQNRPIKLLVRVYVVKATNLAPADPNGKADPYVVVSAGRERQDTKERYIPKQLNPIFGEILELSISLPAETELTVAVFDHDLVGSDDLIGETHIDLENRFYSHHRANCGLASQYEVDGYNAWRDAFWPSQILAGLCQRCGLPAPEYRAGAVKVGSKVFLTPPETLPPGSSSPTVASGDPEEAQALLVLRRWQEMPGFGIQLVPEHVETRPLYHPHSPGLLQGSLHMWIDIFPQDVPAPPPVDIKPRQPISYELRVVIWNTEDVVLDDENPLTGEMSSDIYVKSWVKGLEHDKQETDVHFNSLTGEGNFNWRFVFRFDYLPTEREVSVWRRSGPFALEEAEFRQPAVLVLQVWDYDRISANDFLGSLELQLPDMVRGARGPELCSVQLARNGAGPRCNLFRCRRLRGWWPVVKLKEAEDVEREAQEAQAGKKKRKQRRRKGRPEDLEFTDMGGNVYILTGKVEAEFELLTVEEAEKRPVGKGRKQPEPLEKPSRPKTSFNWFVNPLKTFVFFIWRRYWRTLVLLLLVLLTVFLLLVFYTIPGQISQVIFRPLHK

SEQ ID NO: 30 - DNA, 6855 bp, Homo sapiens
  CDS (2932)...(4764)
agaagaaagctggtaggggctgggagagggtaccacaggggagtatgatctacttgggggccagagaaggttccctgaggaaatagtacctgaacttagacttgaaggataacagatgttaactgggaggagagaatgttccaggcagaggaaaaggcatatgcaaaagtccagcgccttgaaggagcacagctggggtgcctggagtgagatggagctggaaagatccaggtggagcttgacctgaagtaccagcccccagagggcgctactggagcctggtcagaggaggactttggggcacccatccaggacagcttcgagttaatcatccccaatgtgggcttccaggaactggagcctggggaggcccagctggagcggcgggcagtggctctaggccgcaggctagctcgaagtctaggccagcaggacgatgaagagaatgagctggagcttgagctggagcaggacctggatgatgagcctgacgtggaactttctggtgttatgttcagccccctcaagagccgcgccagggccctggcccatggggatcccttccaggtgtccagagctcaagacttccaggtgggagtcactgtgctggaagcccagaaactggtgggagtcaacattaacccctatgtggccgtgcaagtgggggggcagcgccgtgtgaccgccacacagcgtgggaccagttgccccttctacaatgagtacttcttgttcgaatttcatgacacgcggcttcgtctccaagacttgctgctggagatcacggtgagtggggtaggggtgaccagtgtccttcagagaaggggggatgagaaagctgcaggactaacaccaccttcccccaaggctttccattcgcagaccctcccctttatggccacccggataggcaccttcaggatggacctgggcatcatcttggaccagccaggtatggaatcgtccccttattgagactctgcacggacaagggccctagagattgaccctgcagtgactccgcatggacccctatacactcacttcggagagggccatctctggcggaggctgaactcttggcacttccgcccctccctgctgagccagagaagccctggccattgtccgtcactccgatagcctcacggccaccctgtgcgtcccgccggtcgccccttacccctggctcgccccttcgcccttagatggccagttctaccaaagatgggttccgctgcatgatccccgagacacccgcgccgggaccaagggtttcattaaggtcaccttgtccgtgagggcgcgcggggacctgccccctccaatgctacccccggccccagggcactgttcggacatcgagaagtgagccggggtgaggtggggaggaggacatggatccgggggtggccgtggggcgcggataaggggaggggccgagatcccagtttctccccccccgctcggtgccccctcccctaggaacctgctcctgccgcgcggggtgcccgccgagaggccatgggcgcggctccgcgtgcgcctgtaccgcgccgaggggcttcccgcgctgcgcctggggctgctgggcagcctggtccgcgccctgcacgaccagcgcgtcctggtggagccctatgtgcgggtgtctttcctggggcaggagggcgagacgtcggtgagcgccgaggcggcggcgcccgaatggaacgagcagctgagcttcgtggagctcttcccgccgctgacgcgcagcctccgcctgcagctgcgggacgacgcgcccctggtcgacgcggcactcgctacgcacgtgccggacctgaggcggatctcccatccgggccgcgcggcggggtttaaccctaccttcggcccggcctgggtgcccctctatggctcgccccccggcgcggggctccgggatagtcttcaaggtctcaacgaaggcgttggccaaggcatttggttccgcggccgccttctgctggctgtgtccatgcaggtgttggaagggagagctgaacctgagcctccccaggcccagcaggggtccacgttgtcccggctcacccgaaagaagaaaaagaaagccagaagggatcagaccccaaaggcggttccgcagcacttggacgccagccccggtgccgaggggcctgagatcccccgtgccatggaggtggaggtggaggagctgctgccgctgccagagaatgtcctggcgccctgtgaagatttcctgcttttcggtgtgctcttcgaggccaccatgatcgaccccaccgtggcctcccagcccatcagcttcgagatctccattggtgtgtggcctagccgaacccctgagtgccatttcagaccttagaaccctggaaggggtgttgactttcagtcgcgcaggccgtctggaggagcaattgggccgagggtccagggctggggagggaactgagggtgcagccgtggaggctcagcctctgctgggagccaggccagaggaggagaaagaggaggaagaactggggacccatgctcagcggcctgagcccatggacggcagtgggccatacttctgcttgcccctctgtcactgcaagccatgcatgcatgtgtggagttgctgggaggaccacacctggcgcctgcagagcagcaactgcgtgcgcaaagtggccgagaggctggaccaggggctgcaggaggttgagagactgcagcgcaagccggggcctggcgcctgtgcacagctcaagcaggcactggaagtactggtggctgggagcagacagttttgccacggtgccgagcgcaggacgatgacccggcccaatgccctggatcgatgccgagggaaactcctggtgcacagcctgaaccttttggctaagcaaggactgcgacttctacgcggcctgagacggcgcaatgtgcaaaagaaggtggcactggccaagaagctcctggcaaaactgcgctttctggctgaggaggcacccggggcagcccctggtgaggtctgtgccaagctggagctcttcctgcggctgggcctgggcaagcaagccaaggcctgcacctctgagctgcccccggatttgctgcccgagccctcagccgggctgccctccagcctacaccgggacggtcctggagcagacgctgagccctctgtgggatgaactcctggtatttgagcagttgatcgtggatgggaggagggagcacctgcaggaggagcctccattagtgatcatcaatgtatttgaccacaataagtttggcccccccgtgttcctgggcagggcactggccgccccaagggtaaagctgatggaggacccataccaacgcccagagttgcagttcttccccctgaggaagggaccctgggcagccggagagctcattgccgcctttcaactcattgaactagactacagtggccgacttgagccctcagtgcccagtgaggtggagccccaggatctggcacccctggttgagccccactctggacgcctgtcccttccacccaacgtgtgcccagtgctcagggagttccgtgttgaggtgctgttctggggtcttaggggacttggtcgtgtgcatctgctcgaggtggagcagccccaggttgtactggaggtggctgggcaaggtgtggagtctgaggtcctggccagctaccgtgagagccccaatttcactgagcttgtcaggcatctgacagtggtcttcaaagacacagctcctctcttccacccccaggacttgccggagcagccttacttgcagcctccactcagcatcttggtgattgagcgccgggcctttggccacacagtccttgtgggttcccacattgtcccccacatgctgcgattcacatttcggggtcatgaggatcctcctgaggaggaaggagagatggaggagacaggggatatgatgcccaagggacctcaaggacagaagtccctggatcccttcttggctgaagcgggtatatccagacagctcctgaagcacaactttgatgaagatgaaatggatgatcctggagattcagatggggtcaacctcatttctatggttggggagatccaagaccagggtgaggctgaagtcaaaggcactgtgtccccaaaaaaagcagttgccaccctgaagatctacaacaggtccctgaaggaagaatttaaccactttgaagactggctgaatgtgtttcctctgtaccgagggcaagggggccaggatggaggtggagaagaggaaggatctggacaccttgtgggcaagttcaagggctccttcctcatttaccctgaatcagaggcagtgttgttctctgagccccagatctcccgggggatcccacagaaccggcccatcaagctcctggtcagagtgtatgttgtaaaggctaccaacctggctcctgcagaccccaatggcaaagcagacccttacgtggtggtgagcgctggccgggagcggcaggacaccaaggaacgctacatccccaagcagctcaaccccatctttggagagatcctggagctaagcatctctctcccagctgagacggagctgacggtcgccgtatttgatcatgacctcgtgggttctgacgacctcatcggggagacccacattgatctggaaaaccgattctatagccaccacagagcaaactgtgggctggcctcccagtatgaagtgtgggtccagcagggcccacaggagccattctgagtttctggccaaacacattcaagctcacattcccttttgtgtctccagatcctatgatttcatggaaggggaccctcccacccaccgccactgccaaccaagacatagctcagtggtcaagacttgggcttgggagtcgggatcctgtaacgaatgtcacttgaccgctttctttttttatgaaacagtctcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatattttcgctctgtctcccaggttggagtgcagtggcacgatctcggctgactgcaacctccacctcctgggttcaagcgattctcctgcctcagcctccccagtagctgggattacaggcgtgggcccccatgtccagctaatttttatatttttagtagagacagggtttcaccatgttgtccaggctggtcttgaacccctgacctcaagtgatccacccacctctgcctcccaaagtgctgggattacaggtgtgagccaccatgccaggccctcttaacctcttcaagtctgttttctcatctgcaaaacagaggtaataagatcagtatcttcttaatggaagcacctggactacatttttttcattcattgttatcataaatgaggactaacctgtctcccgttgggagttttgaacctagacctcatgtcttcatgacgtcatcactgccccaggcccagctgtgtccctacaccagccccagctgacgcatcttctttttctgcctgtagagatggttacaatgcctggcgtgatgcattctggccttcgcagatcctggcggggctgtgccaacgctgtggcctccctgcccctgaataccgagccggtgctgtcaaggtgggcagcaaagtcttcctgacaccaccggagaccctgcccccagggatctcttcacatgtggattgacatctttcctcaagatgtgcctgctccacccccagttgacatcaagcctcggcagccaatcagctatgagctcagagttgtcatctggaacacggaggatgtggttctggatgacgagaatccactcaccggagagatgtcgagtgacatctatgtgaagagctgggtgaaggggttggagcatgacaagcaggagacagacgttcacttcaactccctgactggggaggggaacttcaattggcgctttgtgttccgctttgactacctgcccacggagcgggaggtgagcgtctggcgcaggtctggaccctttgccctggaggaggcggagttccggcagcctgcagtgctggtcctgcaggatccctggagttgcagctaccagacatggtgcgtggggcccggggccccgagctctgctctgtgcagctggcccgcaatggggccgggccgaggtgcaatctgtttcgctgccgccgcctgaggggctggtggccggtagtgaagctgaaggaggcagaggacgtggagcgggaggcgcaggaggctcaggctggcaagaagaagcgaaagcagaggaggaggaagggccggccagaagacctggagttcacagacatgggtggcaatgtgtacatcctcacgggcaaggtggaggcagagtttgagctgctgactgtggaggaggccgagaaacggccagtggggaaggggcggaagcagccagagcctctggagaaacccagccgccccaaaacttccttcaactggtttgtgaacccgctgaagacctttgtcttcttcatctggcgccggtactggcgcaccctggtgctgctgctactggtgctgctcaccgtcttcctcctcctggtcttctacaccatccctggccagatcagccaggtcatcttccgtcccctccacaagtgactctcgctgaccttggacactcacccagggtgccaacccttcaatgcctgctcctggaagtctttcttacccatgtgagctaccccagagtctagtgcttcctctgaataaacctatcacagcc

SEQ ID NO: 31 - protein, 610 aa, Homo sapiens
MCKRRWHWPRSSWQNCAFWLRRHPGQPLVRSVPSWSSSCGWAWASKPRPAPLSCPRICCPSPQPGCPPAYTGTVLEQTLSPLWDELLVFEQLIVDGRREHLQEEPPLVIINVFDHNKFGPPVFLGRALAAPRVKLMEDPYQRPELQFFPLRKGPWAAGELIAAFQLIELDYSGRLEPSVPSEVEPQDLAPLVEPHSGRLSLPPNVCPVLREFRVEVLFWGLRGLGRVHLLEVEQPQVVLEVAGQGVESEVLASYRESPNFTELVRHLTVVFKDTAPLFHPQDLPEQPYLQPPLSILVIERRAFGHTVLVGSHIVPHMLRFTFRGHEDPPEEEGEMEETGDMMPKGPQGQKSLDPFLAEAGISRQLLKHNFDEDEMDDPGDSDGVNLISMVGEIQDQGEAEVKGTVSPKKAVATLKIYNRSLKEEFNHFEDWLNVFPLYRGQGGQDGGGEEEGSGHLVGKFKGSFLIYPESEAVLFSEPQISRGIPQNRPIKLLVRVYVVKATNLAPADPNGKADPYVVVSAGRERQDTKERYIPKQLNPIFGEILELSISLPAETELTVAVFDHDLVGSDDLIGETHIDLENRFYSHHRANCGLASQYEVWVQQGPQEPF

SEQ ID NO: 32 - DNA, 6125 bp, Homo sapiens
  CDS (65)...(6001)
caggtgggcgggctggtgggcagaagggcagacgggcagaggaagtgccagtgccactgggaccatggctctgacggtaagcgtgcaacgactaacagggctgaccggcacccacgaccgacaagtgaagctcacctttcgaggctttacccagaaaacaagaaaaattcactgtggtccagaagcagatatcggtgagctgttccgatggccccactatggggctccactggctggggagtgtctgtctgtgcaggtggtcaactgcagccgtgtattcagccttaggcctctagggaccctggtgatctccctgcagcagctacagaatgctgggcatttggtgctacgggaagccctagtggatgagaatcttcaagtgtccccgatccaggtggagcttgacctgaagtaccagcccccagagggcgctactggagcctggtcagaggaggactttggggcacccatccaggacagcttcgagttaatcatccccaatgtgggcttccaggaactggagcctggggaggcccagctggagcggcgggcagtggctctaggccgcaggctagctcgaagtctaggccagcaggacgatgaagagaatgagctggagcttgagctggagcaggacctggatgatgagcctgacgtggaactttctggtgttatgttcagccccctcaagagccgcgccagggccctggcccatggggatcccttccaggtgtccagagctcaagacttccaggtgggagtcactgtgctggaagcccagaaactggtgggagtcaacattaacccctatgtggccgtgcaagtgggggggcagcgccgtgtgaccgccacacagcgtgggaccagttgccccttctacaatgagtacttcttgttcgaatttcatgacacgcggcttcgtctccaagacttgctgctggagatcacggtgagtggggtaggggtgaccagtgtccttcagagaaggggggatgagaaagctgcaggactaacaccaccttcccccaaggctttccattcgcagaccctcccctttatggccacccggataggcaccttcaggatggacctgggcatcatcttggaccagccagatggccagttctaccaaagatgggttccgctgcatgatccccgagacacccgcgccgggaccaagggtttcattaaggtcaccttgtccgtgagggcgcgcggggacctgccccctccaatgctacccccggccccagggcactgttcggacatcgagaagaacctgctcctgccgcgcggggtgcccgccgagaggccatgggcgcggctccgcgtgcgcctgtaccgcgccgaggggcttcccgcgctgcgcctggggctgctgggcagcctggtccgcgccctgcacgaccagcgcgtcctggtggagccctatgtgcgggtgtctttcctggggcaggagggcgagacgtcggtgagcgccgaggcggcggcgcccgaatggaacgagcagctgagcttcgtggagctcttcccgccgctgacgcgcagcctccgcctgcagctgcgggacgacgcgcccctggtcgacgcggcactcgctacgcacgtgccggacctgaggcggatctcccatccgggccgcgcggcggggtttaaccctaccttcggcccggcctgggtgcccctctatggctcgccccccggcgcggggctccgggatagtcttcaaggtctcaacgaaggcgttggccaaggcatttggttccgcggccgccttctgctggctgtgtccatgcaggtgttggaagggagagctgaacctgagcctccccaggcccagcaggggtccacgttgtcccggctcacccgaaagaagaaaaagaaagccagaagggatcagaccccaaaggcggttccgcagcacttggacgccagccccggtgccgaggggcctgagatcccccgtgccatggaggtggaggtggaggagctgctgccgctgccagagaatgtcctggcgccctgtgaagatttcctgcttttcggtgtgctcttcgaggccaccatgatcgaccccaccgtggcctcccagcccatcagcttcgagatctccattggtcgcgcaggccgtctggaggagcaattgggccgagggtccagggctggggagggaactgagggtgcagccgtggaggctcagcctctgctgggagccaggccagaggaggagaaagaggaggaagaactggggacccatgctcagcggcctgagcccatggacggcagtgggccatacttctgcttgcccctctgtcactgcaagccatgcatgcatgtgtggagttgctgggaggaccacacctggcgcctgcagagcagcaactgcgtgcgcaaagtggccgagaggctggaccaggggctgcaggaggttgagagactgcagcgcaagccggggcctggcgcctgtgcacagctcaagcaggcactggaagtactggtggctgggagcagacagttttgccacggtgccgagcgcaggacgatgacccggcccaatgccctggatcgatgccgagggaaactcctggtgcacagcctgaaccttttggctaagcaaggactgcgacttctacgcggcctgagacggcgcaatgtgcaaaagaaggtggcactggccaagaagctcctggcaaaactgcgctttctggctgaggagccccagccacccctccccgatgtgctggtctggatgctcagcgggcagcgccgtgtggcctgggcccggatccctgcccaggatgtgctgttctctgtggttgaggaggaacggggccgagactgtgggaagatccagagtctaatgctcacggcacccggggcagcccctggtgaggtctgtgccaagctggagctcttcctgcggctgggcctgggcaagcaagccaaggcctgcacctctgagctgcccccggatttgctgcccgagccctcagccgggctgccctccagcctacaccgggacgactttagctacttccaactccgggctcacttgtaccaggcccggggtgtgttggctgcagatgacagtggcctctcggacccctttgctcgagtcctcatctctacccagtgtcagaccacacgggtcctggagcagacgctgagccctctgtgggatgaactcctggtatttgagcagttgatcgtggatgggaggagggagcacctgcaggaggagcctccattagtgatcatcaatgtatttgaccacaataagtttggcccccccgtgttcctgggcagggcactggccgccccaagggtaaagctgatggaggacccataccaacgcccagagttgcagttcttccccctgaggaagggaccctgggcagccggagagctcattgccgcctttcaactcattgaactagactacagtggccgacttgagccctcagtgcccagtgaggtggagccccaggatctggcacccctggttgagccccactctggacgcctgtcccttccacccaacgtgtgcccagtgctcagggagttccgtgttgaggtgctgttctggggtcttaggggacttggtcgtgtgcatctgctcgaggtggagcagccccaggttgtactggaggtggctgggcaaggtgtggagtctgaggtcctggccagctaccgtgagagccccaatttcactgagcttgtcaggcatctgacagtggacttgccggagcagccttacttgcagcctccactcagcatcttggtgattgagcgccgggcctttggccacacagtccttgtgggttcccacattgtcccccacatgctgcgattcacatttcggggtcatgaggatcctcctgaggaggaaggagagatggaggagacaggggatatgatgcccaagggacctcaaggacagaagtccctggatcccttcttggctgaagcgggtatatccagacagctcctgaagcctcctctgaagaagctcccactaggaggcctcctaaatcaaggccctgggctggaggaagacatcccagatccagaggagctcgactgggggtccaagtactatgcgtcgctgcaggagctccaggggcagcacaactttgatgaagatgaaatggatgatcctggagattcagatggggtcaacctcatttctatggttggggagatccaagaccagggtgaggctgaagtcaaaggcactgtgtccccaaaaaaagcagttgccaccctgaagatctacaacaggtccctggaggaagaatttaaccactttgaagactggctgaatgtgtttcctctgtaccgagggcaagggggccaggatggaggtggagaagaggaaggatctggacaccttgtgggcaagttcaagggctccttcctcatttaccctgaatcagaggcagtgttgttctctgagccccagatctcccgggggatcccacagaaccggcccatcaagctcctggtcagagtgtatgttgtaaaggctaccaacctggctcctgcagaccccaatggcaaagcagacccttacgtggtggtgagcgctggccgggagcggcaggacaccaaggaacgctacatccccaagcagctcaaccccatctttggagagatcctggagctaagcatctctctcccagctgagacggagctgacggtcgccgtatttgatcatgacctcgtgggttctgacgacctcatcggggagacccacattgatctggaaaaccgattctatagccaccacagagcaaactgtgggctggcctcccagtatgaagtagatggttacaatgcctggcgtgatgcattctggccttcgcagatcctggcggggctgtgccaacgctgtggcctccctgcccctgaataccgagccggtgctgtcaaggtgggcagcaaagtcttcctgacaccaccggagaccctgcccccagtggcgagcggggaccctgaagaggcccaggcattgcttgtgctgcggcgctggcaggaaatgccgggttttgggatccagctggtacccgagcatgtagaaaccaggcctctctaccatccccacagcccagggctgctacagggatctcttcacatgtggattgacatctttcctcaagatgtgcctgctccacccccagttgacatcaagcctcggcagccaatcagctatgagctcagagttgtcatctggaacacggaggatgtggttctggatgacgagaatccactcaccggagagatgtcgagtgacatctatgtgaagagctgggtgaaggggttggagcatgacaagcaggagacagacgttcacttcaactccctgactggggaggggaacttcaattggcgctttgtgttccgctttgactacctgcccacggagcgggaggtgagcgtctggcgcaggtctggaccctttgccctggaggaggcggagttccggcagcctgcagtgctggtcctgcaggtctgggactatgaccgcatctctgccaatgacttccttggatccctggagttgcagctaccagacatggtgcgtggggcccggggccccgagctctgctctgtgcagctggcccgcaatggggccgggccgaggtgcaatctgtttcgctgccgccgcctgaggggctggtggccggtagtgaagctgaaggaggcagaggacggcaaggtggaggcagagtttgagctgctgactgtggaggaggccgagaaacggccagtggggaaggggcggaagcagccagagcctctggagaaacccagccgccccaaaacttccttcaactggtttgtgaacccgctgaagacctttgtcttcttcatctggcgccggtactggcgcaccctggtgctgctgctactggtgctgctcaccgtcttcctcctcctggtcttctacaccatccctggccagatcagccaggtcatcttccgtcccctccacaagtgactctcgctgaccttggacactcacccagggtgccaacccttcaatgcctgctcctggaagtctttcttacccatgtgagctaccccagagtctagtgcttcctctgaataaacctatcacagcc

SEQ ID NO: 33 - protein, 1978 aa, Homo sapiens
MALTVSVQRLTGLTGTHDRQVKLTFRGFTQKTRKIHCGPEADIGELFRWPHYGAPLAGECLSVQVVNCSRVFSLRPLGTLVISLQQLQNAGHLVLREALVDENLQVSPIQVELDLKYQPPEGATGAWSEEDFGAPIQDSFELIIPNVGFQELEPGEAQLERRAVALGRRLARSLGQQDDEENELELELEQDLDDEPDVELSGVMFSPLKSRARALAHGDPFQVSRAQDFQVGVTVLEAQKLVGVNINPYVAVQVGGQRRVTATQRGTSCPFYNEYFLFEFHDTRLRLQDLLLEITVSGVGVTSVLQRRGDEKAAGLTPPSPKAFHSQTLPFMATRIGTFRMDLGIILDQPDGQFYQRWVPLHDPRDTRAGTKGFIKVTLSVRARGDLPPPMLPPAPGHCSDIEKNLLLPRGVPAERPWARLRVRLYRAEGLPALRLGLLGSLVRALHDQRVLVEPYVRVSFLGQEGETSVSAEAAAPEWNEQLSFVELFPPLTRSLRLQLRDDAPLVDAALATHVPDLRRISHPGRAAGFNPTFGPAWVPLYGSPPGAGLRDSLQGLNEGVGQGIWFRGRLLLAVSMQVLEGRAEPEPPQAQQGSTLSRLTRKKKKKARRDQTPKAVPQHLDASPGAEGPEIPRAMEVEVEELLPLPENVLAPCEDFLLFGVLFEATMIDPTVASQPISFEISIGRAGRLEEQLGRGSRAGEGTEGAAVEAQPLLGARPEEEKEEEELGTHAQRPEPMDGSGPYFCLPLCHCKPCMHVWSCWEDHTWRLQSSNCVRKVAERLDQGLQEVERLQRKPGPGACAQLKQALEVLVAGSRQFCHGAERRTMTRPNALDRCRGKLLVHSLNLLAKQGLRLLRGLRRRNVQKKVALAKKLLAKLRFLAEEPQPPLPDVLVWMLSGQRRVAWARIPAQDVLFSVVEEERGRDCGKIQSLMLTAPGAAPGEVCAKLELFLRLGLGKQAKACTSELPPDLLPEPSAGLPSSLHRDDFSYFQLRAHLYQARGVLAADDSGLSDPFARVLISTQCQTTRVLEQTLSPLWDELLVFEQLIVDGRREHLQEEPPLVIINVFDHNKFGPPVFLGRALAAPRVKLMEDPYQRPELQFFPLRKGPWAAGELIAAFQLIELDYSGRLEPSVPSEVEPQDLAPLVEPHSGRLSLPPNVCPVLREFRVEVLFWGLRGLGRVHLLEVEQPQVVLEVAGQGVESEVLASYRESPNFTELVRHLTVDLPEQPYLQPPLSILVIERRAFGHTVLVGSHIVPHMLRFTFRGHEDPPEEEGEMEETGDMMPKGPQGQKSLDPFLAEAGISRQLLKPPLKKLPLGGLLNQGPGLEEDIPDPEELDWGSKYYASLQELQGQHNFDEDEMDDPGDSDGVNLISMVGEIQDQGEAEVKGTVSPKKAVATLKIYNRSLEEEFNHFEDWLNVFPLYRGQGGQDGGGEEEGSGHLVGKFKGSFLIYPESEAVLFSEPQISRGIPQNRPIKLLVRVYVVKATNLAPADPNGKADPYVVVSAGRERQDTKERYIPKQLNPIFGEILELSISLPAETELTVAVFDHDLVGSDDLIGETHIDLENRFYSHHRANCGLASQYEVDGYNAWRDAFWPSQILAGLCQRCGLPAPEYRAGAVKVGSKVFLTPPETLPPVASGDPEEAQALLVLRRWQEMPGFGIQLVPEHVETRPLYHPHSPGLLQGSLHMWIDIFPQDVPAPPPVDIKPRQPISYELRVVIWNTEDVVLDDENPLTGEMSSDIYVKSWVKGLEHDKQETDVHFNSLTGEGNFNWRFVFRFDYLPTEREVSVWRRSGPFALEEAEFRQPAVLVLQVWDYDRISANDFLGSLELQLPDMVRGARGPELCSVQLARNGAGPRCNLFRCRRLRGWWPVVKLKEAEDGKVEAEFELLTVEEAEKRPVGKGRKQPEPLEKPSRPKTSFNWFVNPLKTFVFFIWRRYWRTLVLLLLVLLTVFLLLVFYTIPGQISQVIFRPLHK

SEQ ID NO: 34 - DNA, 6245 bp, Homo sapiens
  CDS (65)...(6121)
caggtgggcgggctggtgggcagaagggcagacgggcagaggaagtgccagtgccactgggaccatggctctgacggtaagcgtgcaacgactaacagggctgaccggcacccacgaccgacaagtgaagctcacctttcgaggctttacccagaaaacaagaaaaattcactgtggtccagaagcagatatcggtgagctgttccgatggccccactatggggctccactggctggggagtgtctgtctgtgcaggtggtcaactgcagccgtgtattcagccttaggcctctagggaccctggtgatctccctgcagcagctacagaatgctgggcatttggtgctacgggaagccctagtggatgagaatcttcaagtgtccccgatccaggtggagcttgacctgaagtaccagcccccagagggcgctactggagcctggtcagaggaggactttggggcacccatccaggacagcttcgagttaatcatccccaatgtgggcttccaggaactggagcctggggaggcccagctggagcggcgggcagtggctctaggccgcaggctagctcgaagtctaggccagcaggacgatgaagagaatgagctggagcttgagctggagcaggacctggatgatgagcctgacgtggaactttctggtgttatgttcagccccctcaagagccgcgccagggccctggcccatggggatcccttccaggtgtccagagctcaagacttccaggtgggagtcactgtgctggaagcccagaaactggtgggagtcaacattaacccctatgtggccgtgcaagtgggggggcagcgccgtgtgaccgccacacagcgtgggaccagttgccccttctacaatgagtacttcttgttcgaatttcatgacacgcggcttcgtctccaagacttgctgctggagatcacggtgagtggggtaggggtgaccagtgtccttcagagaaggggggatgagaaagctgcaggactaacaccaccttcccccaaggctttccattcgcagaccctcccctttatggccacccggataggcaccttcaggatggacctgggcatcatcttggaccagccagatggccagttctaccaaagatgggttccgctgcatgatccccgagacacccgcgccgggaccaagggtttcattaaggtcaccttgtccgtgagggcgcgcggggacctgccccctccaatgctacccccggccccagggcactgttcggacatcgagaagaacctgctcctgccgcgcggggtgcccgccgagaggccatgggcgcggctccgcgtgcgcctgtaccgcgccgaggggcttcccgcgctgcgcctggggctgctgggcagcctggtccgcgccctgcacgaccagcgcgtcctggtggagccctatgtgcgggtgtctttcctggggcaggagggcgagacgtcggtgagcgccgaggcggcggcgcccgaatggaacgagcagctgagcttcgtggagctcttcccgccgctgacgcgcagcctccgcctgcagctgcgggacgacgcgcccctggtcgacgcggcactcgctacgcacgtgccggacctgaggcggatctcccatccgggccgcgcggcggggtttaaccctaccttcggcccggcctgggtgcccctctatggctcgccccccggcgcggggctccgggatagtcttcaaggtctcaacgaaggcgttggccaaggcatttggttccgcggccgccttctgctggctgtgtccatgcaggtgttggaagggagagctgaacctgagcctccccaggcccagcaggggtccacgttgtcccggctcacccgaaagaagaaaaagaaagccagaagggatcagaccccaaaggcggttccgcagcacttggacgccagccccggtgccgaggggcctgagatcccccgtgccatggaggtggaggtggaggagctgctgccgctgccagagaatgtcctggcgccctgtgaagatttcctgcttttcggtgtgctcttcgaggccaccatgatcgaccccaccgtggcctcccagcccatcagcttcgagatctccattggtcgcgcaggccgtctggaggagcaattgggccgagggtccagggctggggagggaactgagggtgcagccgtggaggctcagcctctgctgggagccaggccagaggaggagaaagaggaggaagaactggggacccatgctcagcggcctgagcccatggacggcagtgggccatacttctgcttgcccctctgtcactgcaagccatgcatgcatgtgtggagttgctgggaggaccacacctggcgcctgcagagcagcaactgcgtgcgcaaagtggccgagaggctggaccaggggctgcaggaggttgagagactgcagcgcaagccggggcctggcgcctgtgcacagctcaagcaggcactggaagtactggtggctgggagcagacagttttgccacggtgccgagcgcaggacgatgacccggcccaatgccctggatcgatgccgagggaaactcctggtgcacagcctgaaccttttggctaagcaaggactgcgacttctacgcggcctgagacggcgcaatgtgcaaaagaaggtggcactggccaagaagctcctggcaaaactgcgctttctggctgaggagccccagccacccctccccgatgtgctggtctggatgctcagcgggcagcgccgtgtggcctgggcccggatccctgcccaggatgtgctgttctctgtggttgaggaggaacggggccgagactgtgggaagatccagagtctaatgctcacggcacccggggcagcccctggtgaggtctgtgccaagctggagctcttcctgcggctgggcctgggcaagcaagccaaggcctgcacctctgagctgcccccggatttgctgcccgagccctcagccgggctgccctccagcctacaccgggacgactttagctacttccaactccgggctcacttgtaccaggcccggggtgtgttggctgcagatgacagtggcctctcggacccctttgctcgagtcctcatctctacccagtgtcagaccacacgggtcctggagcagacgctgagccctctgtgggatgaactcctggtatttgagcagttgatcgtggatgggaggagggagcacctgcaggaggagcctccattagtgatcatcaatgtatttgaccacaataagtttggcccccccgtgttcctgggcagggcactggccgccccaagggtaaagctgatggaggacccataccaacgcccagagttgcagttcttccccctgaggaagggaccctgggcagccggagagctcattgccgcctttcaactcattgaactagactacagtggccgacttgagccctcagtgcccagtgaggtggagccccaggatctggcacccctggttgagccccactctggacgcctgtcccttccacccaacgtgtgcccagtgctcagggagttccgtgttgaggtgctgttctggggtcttaggggacttggtcgtgtgcatctgctcgaggtggagcagccccaggttgtactggaggtggctgggcaaggtgtggagtctgaggtcctggccagctaccgtgagagccccaatttcactgagcttgtcaggcatctgacagtggacttgccggagcagccttacttgcagcctccactcagcatcttggtgattgagcgccgggcctttggccacacagtccttgtgggttcccacattgtcccccacatgctgcgattcacatttcggggtcatgaggatcctcctgaggaggaaggagagatggaggagacaggggatatgatgcccaagggacctcaaggacagaagtccctggatcccttcttggctgaagcgggtatatccagacagctcctgaagcctcctctgaagaagctcccactaggaggcctcctaaatcaaggccctgggctggaggaagacatcccagatccagaggagctcgactgggggtccaagtactatgcgtcgctgcaggagctccaggggcagcacaactttgatgaagatgaaatggatgatcctggagattcagatggggtcaacctcatttctatggttggggagatccaagaccagggtgaggctgaagtcaaaggcactgtgtccccaaaaaaagcagttgccaccctgaagatctacaacaggtccctggaggaagaatttaaccactttgaagactggctgaatgtgtttcctctgtaccgagggcaagggggccaggatggaggtggagaagaggaaggatctggacaccttgtgggcaagttcaagggctccttcctcatttaccctgaatcagaggcagtgttgttctctgagccccagatctcccgggggatcccacagaaccggcccatcaagctcctggtcagagtgtatgttgtaaaggctaccaacctggctcctgcagaccccaatggcaaagcagacccttacgtggtggtgagcgctggccgggagcggcaggacaccaaggaacgctacatccccaagcagctcaaccccatctttggagagatcctggagctaagcatctctctcccagctgagacggagctgacggtcgccgtatttgatcatgacctcgtgggttctgacgacctcatcggggagacccacattgatctggaaaaccgattctatagccaccacagagcaaactgtgggctggcctcccagtatgaagtagatggttacaatgcctggcgtgatgcattctggccttcgcagatcctggcggggctgtgccaacgctgtggcctccctgcccctgaataccgagccggtgctgtcaaggtgggcagcaaagtcttcctgacaccaccggagaccctgcccccagtggcgagcggggaccctgaagaggcccaggcattgcttgtgctgcggcgctggcaggaaatgccgggttttgggatccagctggtacccgagcatgtagaaaccaggcctctctaccatccccacagcccagggctgctacagggatctcttcacatgtggattgacatctttcctcaagatgtgcctgctccacccccagttgacatcaagcctcggcagccaatcagctatgagctcagagttgtcatctggaacacggaggatgtggttctggatgacgagaatccactcaccggagagatgtcgagtgacatctatgtgaagagctgggtgaaggggttggagcatgacaagcaggagacagacgttcacttcaactccctgactggggaggggaacttcaattggcgctttgtgttccgctttgactacctgcccacggagcgggaggtgagcgtctggcgcaggtctggaccctttgccctggaggaggcggagttccggcagcctgcagtgctggtcctgcaggtctgggactatgaccgcatctctgccaatgacttccttggatccctggagttgcagctaccagacatggtgcgtggggcccggggccccgagctctgctctgtgcagctggcccgcaatggggccgggccgaggtgcaatctgtttcgctgccgccgcctgaggggctggtggccggtagtgaagctgaaggaggcagaggacgtggagcgggaggcgcaggaggctcaggctggcaagaagaagcgaaagcagaggaggaggaagggccggccagaagacctggagttcacagacatgggtggcaatgtgtacatcctcacgggcaaggtggaggcagagtttgagctgctgactgtggaggaggccgagaaacggccagtggggaaggggcggaagcagccagagcctctggagaaacccagccgccccaaaacttccttcaactggtttgtgaacccgctgaagacctttgtcttcttcatctggcgccggtactggcgcaccctggtgctgctgctactggtgctgctcaccgtcttcctcctcctggtcttctacaccatccctggccagatcagccaggtcatcttccgtcccctccacaagtgactctcgctgaccttggacactcacccagggtgccaacccttcaatgcctgctcctggaagtctttcttacccatgtgagctaccccagagtctagtgcttcctctgaataaacctatcacagcc

SEQ ID NO: 35 - protein, 2018 aa, Homo sapiens
MALTVSVQRLTGLTGTHDRQVKLTFRGFTQKTRKIHCGPEADIGELFRWPHYGAPLAGECLSVQVVNCSRVFSLRPLGTLVISLQQLQNAGHLVLREALVDENLQVSPIQVELDLKYQPPEGATGAWSEEDFGAPIQDSFELIIPNVGFQELEPGEAQLERRAVALGRRLARSLGQQDDEENELELELEQDLDDEPDVELSGVMFSPLKSRARALAHGDPFQVSRAQDFQVGVTVLEAQKLVGVNINPYVAVQVGGQRRVTATQRGTSCPFYNEYFLFEFHDTRLRLQDLLLEITVSGVGVTSVLQRRGDEKAAGLTPPSPKAFHSQTLPFMATRIGTFRMDLGIILDQPDGQFYQRWVPLHDPRDTRAGTKGFIKVTLSVRARGDLPPPMLPPAPGHCSDIEKNLLLPRGVPAERPWARLRVRLYRAEGLPALRLGLLGSLVRALHDQRVLVEPYVRVSFLGQEGETSVSAEAAAPEWNEQLSFVELFPPLTRSLRLQLRDDAPLVDAALATHVPDLRRISHPGRAAGFNPTFGPAWVPLYGSPPGAGLRDSLQGLNEGVGQGIWFRGRLLLAVSMQVLEGRAEPEPPQAQQGSTLSRLTRKKKKKARRDQTPKAVPQHLDASPGAEGPEIPRAMEVEVEELLPLPENVLAPCEDFLLFGVLFEATMIDPTVASQPISFEISIGRAGRLEEQLGRGSRAGEGTEGAAVEAQPLLGARPEEEKEEEELGTHAQRPEPMDGSGPYFCLPLCHCKPCMHVWSCWEDHTWRLQSSNCVRKVAERLDQGLQEVERLQRKPGPGACAQLKQALEVLVAGSRQFCHGAERRTMTRPNALDRCRGKLLVHSLNLLAKQGLRLLRGLRRRNVQKKVALAKKLLAKLRFLAEEPQPPLPDVLVWMLSGQRRVAWARIPAQDVLFSVVEEERGRDCGKIQSLMLTAPGAAPGEVCAKLELFLRLGLGKQAKACTSELPPDLLPEPSAGLPSSLHRDDFSYFQLRAHLYQARGVLAADDSGLSDPFARVLISTQCQTTRVLEQTLSPLWDELLVFEQLIVDGRREHLQEEPPLVIINVFDHNKFGPPVFLGRALAAPRVKLMEDPYQRPELQFFPLRKGPWAAGELIAAFQLIELDYSGRLEPSVPSEVEPQDLAPLVEPHSGRLSLPPNVCPVLREFRVEVLFWGLRGLGRVHLLEVEQPQVVLEVAGQGVESEVLASYRESPNFTELVRHLTVDLPEQPYLQPPLSILVIERRAFGHTVLVGSHIVPHMLRFTFRGHEDPPEEEGEMEETGDMMPKGPQGQKSLDPFLAEAGISRQLLKPPLKKLPLGGLLNQGPGLEEDIPDPEELDWGSKYYASLQELQGQHNFDEDEMDDPGDSDGVNLISMVGEIQDQGEAEVKGTVSPKKAVATLKIYNRSLEEEFNHFEDWLNVFPLYRGQGGQDGGGEEEGSGHLVGKFKGSFLIYPESEAVLFSEPQISRGIPQNRPIKLLVRVYVVKATNLAPADPNGKADPYVVVSAGRERQDTKERYIPKQLNPIFGEILELSISLPAETELTVAVFDHDLVGSDDLIGETHIDLENRFYSHHRANCGLASQYEVDGYNAWRDAFWPSQILAGLCQRCGLPAPEYRAGAVKVGSKVFLTPPETLPPVASGDPEEAQALLVLRRWQEMPGFGIQLVPEHVETRPLYHPHSPGLLQGSLHMWIDIFPQDVPAPPPVDIKPRQPISYELRVVIWNTEDVVLDDENPLTGEMSSDIYVKSWVKGLEHDKQETDVHFNSLTGEGNFNWRFVFRFDYLPTEREVSVWRRSGPFALEEAEFRQPAVLVLQVWDYDRISANDFLGSLELQLPDMVRGARGPELCSVQLARNGAGPRCNLFRCRRLRGWWPVVKLKEAEDVEREAQEAQAGKKKRKQRRRKGRPEDLEFTDMGGNVYILTGKVEAEFELLTVEEAEKRPVGKGRKQPEPLEKPSRPKTSFNWFVNPLKTFVFFIWRRYWRTLVLLLLVLLTVFLLLVFYTIPGQISQVIFRPLHK

SEQ ID NO: 36 - protein, 328 aa, Homo sapiens [sequence omitted]

SEQ ID NO: 37 - protein, 236 aa, Homo sapiens; identical to SEQ ID NO: 5

SEQ ID NO: 38 - protein, 181 aa, Homo sapiens [sequence omitted]

SEQ ID NO: 39 - protein, 328 aa, Homo sapiens [sequence omitted]

SEQ ID NO: 40 - protein, 328 aa, Homo sapiens; identical to SEQ ID NO: 11

SEQ ID NO: 41 - protein, 178 aa, Homo sapiens; identical to SEQ ID NO: 13

SEQ ID NO: 42 - protein, 181 aa, Homo sapiens [sequence omitted]

SEQ ID NO: 43 - protein, 328 aa, Homo sapiens
MWIDIFPQDVPAPPPVDIKPRQPISYELRVVIWNTEDVVLDDENPLTGEMSSDIYVKRWVKGLEHDKQETDVHFNSLTGEGNFNWRFVFRFDYLPTEREVSVWRRSGPFALEEAEFRQPAVLVLQVWDYDRISANDFLGSLELQLPDMVRGARGPELCSVQLARNGAGPRCNLFRCRRLRGWWPVVKLKEAEDVEREAQEAQAGKKKRKQRRRKGRPEDLEFTDMGGNVYILTGKVEAEFELLTVEEAEKRPVGKGRKQPEPLEKPSRPKTSFNWFVNPLKTFVFFIWRRYWRTLVLLLLVLLTVFLLLVFYTIPGQISQVIFRPLHK

SEQ ID NO: 44 - protein, 328 aa, Homo sapiens [sequence omitted]

SEQ ID NO: 45 - protein, 328 aa, Homo sapiens
MWIDIFPQDVPAPPPVDIKPRQPISYELRVVIWNTEDVVLDDENPLTGEMSSDIYVKSWVKGLEHDKQETDVHFNSLTGEGNFNWRFVFRFDYLPTEREVSVWRRSGPFALEEAEFRQPAVLVLQVWDYDRISANDFLGSLELQLPDMVRGARGPELCSVQLARNGAGPRCNLFRCRRLRGWWPVVKLKEAEDVEREAQEAQAGKKKRKQRRRKGRPEDLEFTDMGGNVYILTGKVEAEFELLTVEEAEKRPVGKGRKQPEPLEKPSRPKTSFNWFVNPLNTFVFFIWRRYWRTLVLLLLVLLTVFLLLVFYTIPGQISQVIFRPLHK

SEQ ID NO: 46 - protein, 328 aa, Homo sapiens [sequence omitted]

SEQ ID NO: 47 - protein, 1393 aa, Homo sapiens; identical to SEQ ID NO: 23

SEQ ID NO: 48 - protein, 1145 aa, Homo sapiens [sequence omitted]

SEQ ID NO: 49 - protein, 1990 aa, Homo sapiens; identical to SEQ ID NO: 27

SEQ ID NO: 50 - protein, 2036 aa, Homo sapiens; identical to SEQ ID NO: 29

SEQ ID NO: 51 - protein, 610 aa, Homo sapiens; identical to SEQ ID NO: 31

SEQ ID NO: 52 - protein, 1978 aa, Homo sapiens; identical to SEQ ID NO: 33

SEQ ID NO: 53 - protein, 2018 aa, Homo sapiens; identical to SEQ ID NO: 35

SEQ ID NO: 54 - protein, 328 aa, Homo sapiens [sequence omitted]

SEQ ID NO: 55 - protein, 236 aa, Homo sapiens; identical to SEQ ID NO: 5

SEQ ID NO: 56 - protein, 181 aa, Homo sapiens [sequence omitted]

SEQ ID NO: 57 - protein, 178 aa, Homo sapiens; identical to SEQ ID NO: 13

SEQ ID NO: 58 - protein, 1393 aa, Homo sapiens; identical to SEQ ID NO: 23

SEQ ID NO: 59 - protein, 1145 aa, Homo sapiens [sequence omitted]

SEQ ID NO: 60 - protein, 1990 aa, Homo sapiens; identical to SEQ ID NO: 27

SEQ ID NO: 61 - protein, 2036 aa, Homo sapiens; identical to SEQ ID NO: 29

SEQ ID NO: 62 - protein, 610 aa, Homo sapiens; identical to SEQ ID NO: 31

SEQ ID NO: 63 - protein, 14 aa, Tetanus toxoid
QYIKANSKFIGITE

SEQ ID NO: 64 - protein, 21 aa, Plasmodium falciparum
DIEKKIAKMEKASSVFNVVNS

SEQ ID NO: 65 - protein, 16 aa, Streptococcus
GAVDSILGGVATYGAA

SEQ ID NO: 66 - protein, 13 aa, Artificial Sequence
  Pan-DR Binding Epitope
  VARIANT 3: Xaa = cyclohexyalanine, phenylalanine, or tyrosine
  VARIANT 1, 13: Xaa = d-alanine or I-alanine
XKXVAAWTLKAAX

SEQ ID NO: 67 - DNA, 14 bp, Artificial Sequence
  Primer
ttttgatcaagctt

SEQ ID NO: 68 - DNA, 42 bp, Artificial Sequence
  Primer
ctaatacgactcactatagggctcgagcggccgcccgggcag

SEQ ID NO: 69 - DNA, 12 bp, Artificial Sequence
  Primer
gatcctgcccgg

SEQ ID NO: 70 - DNA, 40 bp, Artificial Sequence
  Primer
gtaatacgactcactatagggcagcgtggtcgcggccgag

SEQ ID NO: 71 - DNA, 10 bp, Artificial Sequence
  Primer
gatcctcggc

SEQ ID NO: 72 - DNA, 22 bp, Artificial Sequence
  Primer
ctaatacgactcactatagggc

SEQ ID NO: 73 - DNA, 22 bp, Artificial Sequence
  Primer
tcgagcggccgcccgggcagga

SEQ ID NO: 74 - DNA, 20 bp, Artificial Sequence
  Primer
agcgtggtcgcggccgagga

SEQ ID NO: 75 - DNA, 25 bp, Artificial Sequence
  Primer
atatcgccgcgctcgtcgtcgacaa

SEQ ID NO: 76 - DNA, 26 bp, Artificial Sequence
  Primer
agccacacgcagctcattgtagaagg

SEQ ID NO: 77 - DNA, 24 bp, Artificial Sequence
  Primer
catctatgtgaagagctgggtgaa

SEQ ID NO: 78 - DNA, 24 bp, Artificial Sequence
  Primer
aggtagtcaaagcggaacacaaag

SEQ ID NO: 79 - DNA, 22 bp, Artificial Sequence
  Primer
gtcctcccagcaactccacaca

SEQ ID NO: 80 - DNA, 23 bp, Artificial Sequence
  Primer
tgtcccttccacccaacgtgtgc

SEQ ID NO: 81 - DNA, 25 bp, Artificial Sequence
  Primer
tcctccatctctccttcctcctcag

SEQ ID NO: 82 - DNA, 22 bp, Artificial Sequence
  Primer
cagaaactggtgggagtcaaca

SEQ ID NO: 83 - DNA, 22 bp, Artificial Sequence
  Primer
atggctctgacggtaagcgtgc

SEQ ID NO: 84 - DNA, 22 bp, Artificial Sequence
  Primer
ataggcaccttcaggatggacc

SEQ ID NO: 85 - DNA, 22 bp, Artificial Sequence
  Primer
tccatcctgaaggtgcctatcc

SEQ ID NO: 86 - DNA, 21 bp, Artificial Sequence
  Primer
cagaggaggagaaagaggagg

SEQ ID NO: 87 - DNA, 20 bp, Artificial Sequence
  Primer
tcctctttctcctcctctgg

SEQ ID NO: 88 - DNA, 23 bp, Artificial Sequence
  Primer
agatccagagtctaatgctcacg

SEQ ID NO: 89 - DNA, 22 bp, Artificial Sequence
  Primer
cgtgagcattagactctggatc

SEQ ID NO: 90 - DNA, 20 bp, Artificial Sequence
  Primer
aaggtgtggagtctgaggtc

SEQ ID NO: 91 - DNA, 21 bp, Artificial Sequence
  Primer
acctcagactccacaccttgc

SEQ ID NO: 92 - DNA, 21 bp, Artificial Sequence
  Primer
actctgaccaggagcttgatg

SEQ ID NO: 93 - DNA, 21 bp, Artificial Sequence
  Primer
acacggaggatgtggttctgg

SEQ ID NO: 94 - DNA, 23 bp, Artificial Sequence
  Primer
ttgagctgctgactgtggaggag

SEQ ID NO: 95 - DNA, 20 bp, Artificial Sequence
  Primer
tcctccacagtcagcagctc

SEQ ID NO: 96 - DNA, 21 bp, Artificial Sequence
  Primer
tgagtgtccaaggtcagcgag

SEQ ID NO: 97 - DNA, 23 bp, Artificial Sequence
  Primer
agagaatgagctggagcttgagc

SEQ ID NO: 98 - DNA, 23 bp, Artificial Sequence
  Primer
tcaagctccagctcattctcttc

SEQ ID NO: 99 - DNA, 24 bp, Artificial Sequence
  Primer
taacaccagaaagttccacgtcag

SEQ ID NO: 100 - DNA, 21 bp, Artificial Sequence
  Primer
tgacggtcgccgtatttgatc

SEQ ID NO: 101 - DNA, 20 bp, Artificial Sequence
  Primer
gattggctgccgaggcttga

SEQ ID NO: 102 - DNA, 21 bp, Artificial Sequence
  Primer
tgacggtcgccgtatttgatc

SEQ ID NO: 103 - DNA, 24 bp, Artificial Sequence
  Flag Tag
gattacaaggatgacgacgataag

SEQ ID NO: 104 - DNA, 21 bp, Homo sapiens
cctcggcagccaatcagctat

SEQ ID NO: 105 - DNA, 24 bp, Homo sapiens
aagggacgaagacgaacacuuctt

SEQ ID NO: 106 - DNA, 23 bp, Homo sapiens
aactgaagacctgaagacaataa

SEQ ID NO: 107 - protein, 9 aa, Homo sapiens
SRVFSLRPL

SEQ ID NO: 108 - protein, 9 aa, Homo sapiens
NLQVSPIQV

SEQ ID NO: 109 - protein, 9 aa, Homo sapiens
TGAWSEEDF

SEQ ID NO: 110 - protein, 9 aa, Homo sapiens
RLARSLGQQ

SEQ ID NO: 111 - protein, 9 aa, Homo sapiens
GVMFSPLKS

SEQ ID NO: 112 - protein, 9 aa, Homo sapiens
SPLKSRARA

SEQ ID NO: 113 - protein, 9 aa, Homo sapiens
QRGTSCPFY

SEQ ID NO: 114 - protein, 9 aa, Homo sapiens
LTPPSPKAF

SEQ ID NO: 115 - protein, 9 aa, Homo sapiens
KVTLSVRAR

SEQ ID NO: 116 - protein, 9 aa, Homo sapiens
YVRVSFLGQ

SEQ ID NO: 117 - protein, 9 aa, Homo sapiens
EGETSVSAE

SEQ ID NO: 118 - protein, 9 aa, Homo sapiens
ETSVSAEAA

SEQ ID NO: 119 - protein, 9 aa, Homo sapiens
NEQLSFVEL

SEQ ID NO: 120 - protein, 9 aa, Homo sapiens
LRRISHPGR

SEQ ID NO: 121 - protein, 9 aa, Homo sapiens
HLDASPGAE

SEQ ID NO: 122 - protein, 9 aa, Homo sapiens
SQPISFEIS

SEQ ID NO: 123 - protein, 9 aa, Homo sapiens
SFEISIGRA

SEQ ID NO: 124 - protein, 9 aa, Homo sapiens
DVLFSVVEE

SEQ ID NO: 125 - protein, 9 aa, Homo sapiens
GLPSSLHRD

SEQ ID NO: 126 - protein, 9 aa, Homo sapiens
DSGLSDPFA

SEQ ID NO: 127 - protein, 9 aa, Homo sapiens
ELDYSGRLE

SEQ ID NO: 128 - protein, 9 aa, Homo sapiens
PSVPSEVEP

SEQ ID NO: 129 - protein, 9 aa, Homo sapiens
VEPHSGRLS

SEQ ID NO: 130 - protein, 9 aa, Homo sapiens
SGRLSLPPN

SEQ ID NO: 131 - protein, 9 aa, Homo sapiens
EVLASYRES

SEQ ID NO: 132 - protein, 9 aa, Homo sapiens
SYRESPNFT

SEQ ID NO: 133 - protein, 9 aa, Homo sapiens
DPGDSDGVN

SEQ ID NO: 134 - protein, 9 aa, Homo sapiens
KGTVSPKKA

SEQ ID NO: 135 - protein, 9 aa, Homo sapiens
IYNRSLKEE

SEQ ID NO: 136 - protein, 9 aa, Homo sapiens
YVVVSAGRE

SEQ ID NO: 137 - protein, 9 aa, Homo sapiens
NRFYSHHRA

SEQ ID NO: 138 - protein, 9 aa, Homo sapiens
CGLASQYEV

SEQ ID NO: 139 - protein, 9 aa, Homo sapiens
LPPGSSSPT

SEQ ID NO: 140 - protein, 9 aa, Homo sapiens
PGSSSPTVA

SEQ ID NO: 141 - protein, 9 aa, Homo sapiens
YHPHSPGLL

SEQ ID NO: 142 - protein, 9 aa, Homo sapiens
RQPISYELR

SEQ ID NO: 143 - protein, 9 aa, Homo sapiens
EREVSVWRR

SEQ ID NO: 144 - protein, 9 aa, Homo sapiens
VWRRSGPFA

SEQ ID NO: 145 - protein, 9 aa, Homo sapiens
YDRISANDF

SEQ ID NO: 146 - protein, 9 aa, Homo sapiens
LEKPSRPKT

SEQ ID NO: 147 - protein, 9 aa, Homo sapiens
FRGFTQKTR

SEQ ID NO: 148 - protein, 9 aa, Homo sapiens
QRRVTATQR

SEQ ID NO: 149 - protein, 9 aa, Homo sapiens
RVTATQRGT

SEQ ID NO: 150 - protein, 9 aa, Homo sapiens
TQRGTSCPF

SEQ ID NO: 151 - protein, 9 aa, Homo sapiens
TRIGTFRMD

SEQ ID NO: 152 - protein, 9 aa, Homo sapiens
DPRDTRAGT

SEQ ID NO: 153 - protein, 9 aa, Homo sapiens
LSRLTRKKK

SEQ ID NO: 154 - protein, 9 aa, Homo sapiens
RRDQTPKAV

SEQ ID NO: 155 - protein, 9 aa, Homo sapiens
AGEGTEGAA

SEQ ID NO: 156 - protein, 9 aa, Homo sapiens
RRTMTRPNA

SEQ ID NO: 157 - protein, 9 aa, Homo sapiens
VLISTQCQT

SEQ ID NO: 158 - protein, 9 aa, Homo sapiens
TQCQTTRVL

SEQ ID NO: 159 - protein, 9 aa, Homo sapiens
VLEQTLSPL

SEQ ID NO: 160 - protein, 9 aa, Homo sapiens
VRHLTVVFK

SEQ ID NO: 161 - protein, 9 aa, Homo sapiens
KAVATLKIY

SEQ ID NO: 162 - protein, 9 aa, Homo sapiens
ERQDTKERY

SEQ ID NO: 163 - protein, 9 aa, Homo sapiens
ETELTVAVF

SEQ ID NO: 164 - protein, 9 aa, Homo sapiens
KVFLTPPET

SEQ ID NO: 165 - protein, 9 aa, Homo sapiens
VIWNTEDVV

SEQ ID NO: 166 - protein, 9 aa, Homo sapiens
DYLPTEREV

SEQ ID NO: 167 - protein, 9 aa, Homo sapiens
VYILTGKVE

SEQ ID NO: 168 - protein, 9 aa, Homo sapiens
FELLTVEEA

SEQ ID NO: 169 - protein, 9 aa, Homo sapiens
SRPKTSFNW

SEQ ID NO: 170 - protein, 9 aa, Homo sapiens
RWPHYGAPL

SEQ ID NO: 171 - protein, 9 aa, Homo sapiens
LVEPYVRVS

SEQ ID NO: 172 - protein, 9 aa, Homo sapiens
WVPLYGSPP

SEQ ID NO: 173 - protein, 9 aa, Homo sapiens
DDFSYFQLR

SEQ ID NO: 174 - protein, 9 aa, Homo sapiens
MEDPYQRPE

SEQ ID NO: 175 - protein, 9 aa, Homo sapiens
PEQPYLQPP

SEQ ID NO: 176 - protein, 9 aa, Homo sapiens
KADPYVVVS

SEQ ID NO: 177 - protein, 9 aa, Homo sapiens
TKERYIPKQ

SEQ ID NO: 178 - protein, 9 aa, Homo sapiens
EVDGYNAWR

SEQ ID NO: 179 - protein, 9 aa, Homo sapiens
PAPEYRAGA

SEQ ID NO: 180 - protein, 9 aa, Homo sapiens
SSDIYVKSW

SEQ ID NO: 181 - protein, 4 aa, Homo sapiens
NCSR

SEQ ID NO: 182 - protein, 4 aa, Homo sapiens
NFTE

SEQ ID NO: 183 - protein, 4 aa, Homo sapiens
NRSL

SEQ ID NO: 184 - protein, 13 aa, Homo sapiens
RRTMTRPSEQIDN

SEQ ID NO: 185 - protein, 4 aa, Homo sapiens
TPKA

SEQ ID NO: 186 - protein, 4 aa, Homo sapiens
TEGA

SEQ ID NO: 187 - protein, 4 aa, Homo sapiens
TWRL

SEQ ID NO: 188 - protein, 4 aa, Homo sapiens
TSEL

SEQ ID NO: 189 - protein, 4 aa, Homo sapiens
TAPL

SEQ ID NO: 190 - protein, 4 aa, Homo sapiens
TLKI

SEQ ID NO: 191 - protein, 4 aa, Homo sapiens
TRPL

SEQ ID NO: 192 - protein, 8 aa, Homo sapiens
FGPAWVPL

SEQ ID NO: 193 - protein, 4 aa, Homo sapiens
DENL

SEQ ID NO: 194 - protein, 4 aa, Homo sapiens
FELI

SEQ ID NO: 195 - protein, 4 aa, Homo sapiens
RDSL

SEQ ID NO: 196 - protein, 4 aa, Homo sapiens
NEGV

SEQ ID NO: 197 - protein, 4 aa, Homo sapiens
VEEL

SEQ ID NO: 198 - protein, 4 aa, Homo sapiens
EELL

SEQ ID NO: 199 - protein, 4 aa, Homo sapiens
PENV

SEQ ID NO: 200 - protein, 4 aa, Homo sapiens
EDFL

SEQ ID NO: 201 - protein, 4 aa, Homo sapiens
EEQL

SEQ ID NO: 202 - protein, 4 aa, Homo sapiens
EEEL

SEQ ID NO: 203 - protein, 4 aa, Homo sapiens
AERL

SEQ ID NO: 204 - protein, 4 aa, Homo sapiens
VERL

SEQ ID NO: 205 - protein, 4 aa, Homo sapiens
LEVL

SEQ ID NO: 206 - protein, 4 aa, Homo sapiens
PDVL

SEQ ID NO: 207 - protein, 4 aa, Homo sapiens
QDVL

SEQ ID NO: 208 - protein, 4 aa, Homo sapiens
PDLL

SEQ ID NO: 209 - protein, 4 aa, Homo sapiens
GELI

SEQ ID NO: 210 - protein, 4 aa, Homo sapiens
VEVL

SEQ ID NO: 211 - protein, 4 aa, Homo sapiens
SEVL

SEQ ID NO: 212 - protein, 4 aa, Homo sapiens
TELV

SEQ ID NO: 213 - protein, 4 aa, Homo sapiens
EEDI

SEQ ID NO: 214 - protein, 4 aa, Homo sapiens
PEEL

SEQ ID NO: 215 - protein, 4 aa, Homo sapiens
SDGV

SEQ ID NO: 216 - protein, 4 aa, Homo sapiens
EDWL

SEQ ID NO: 217 - protein, 4 aa, Homo sapiens
SEAV

SEQ ID NO: 218 - protein, 4 aa, Homo sapiens
PETL

SEQ ID NO: 219 - protein, 4 aa, Homo sapiens
PEHV

SEQ ID NO: 220 - protein, 4 aa, Homo sapiens
PEDL

SEQ ID NO: 221 - protein, 4 aa, Homo sapiens
FELL

SEQ ID NO: 222 - protein, 4 aa, Homo sapiens
PEPL

SEQ ID NO: 223 - protein, 4 aa, Homo sapiens
YQPP

SEQ ID NO: 224 - protein, 7 aa, Homo sapiens
RAEPEPP

SEQ ID NO: 225 - protein, 7 aa, Homo sapiens
RLEPSVP

SEQ ID NO: 226 - protein, 7 aa, Homo sapiens
LPPPMLP

SEQ ID NO: 227 - protein, 7 aa, Homo sapiens
PMLPPAP

SEQ ID NO: 228 - protein, 7 aa, Homo sapiens
RAEPEPP

SEQ ID NO: 229 - protein, 7 aa, Homo sapiens
AEGPEIP

SEQ ID NO: 230 - protein, 7 aa, Homo sapiens
PENVLAP

SEQ ID NO: 231 - protein, 7 aa, Homo sapiens
AEEPQPP

SEQ ID NO: 232 - protein, 7 aa, Homo sapiens
EPQPPLP

SEQ ID NO: 233 - protein, 7 aa, Homo sapiens
RLEPSVP

SEQ ID NO: 234 - protein, 7 aa, Homo sapiens
LLEVEQP

SEQ ID NO: 235 - protein, 7 aa, Homo sapiens
QDLPEQP

SEQ ID NO: 236 - protein, 7 aa, Homo sapiens
DMMPKGP

SEQ ID NO: 237 - protein, 7 aa, Homo sapiens
LYHPHSP

SEQ ID NO: 238 - protein, 7 aa, Homo sapiens
PQDVPAP

SEQ ID NO: 239 - protein, 7 aa, Homo sapiens
QDVPAPP

SEQ ID NO: 240 - protein, 7 aa, Homo sapiens
DIKPRQP

SEQ ID NO: 241 - protein, 7 aa, Homo sapiens
LEKPSRP

SEQ ID NO: 242 - protein, 8 aa, Homo sapiens
KPPLKKLP

SEQ ID NO: 243 - protein, 4 aa, Homo sapiens
PEEE

SEQ ID NO: 244 - protein, 4 aa, Homo sapiens
PPEE

SEQ ID NO: 245 - protein, 4 aa, Homo sapiens
PEEE

SEQ ID NO: 246 - protein, 4 aa, Homo sapiens
SLQE

SEQ ID NO: 247 - protein, 4 aa, Homo sapiens
TVEE

SEQ ID NO: 248 - protein, 9 aa, Homo sapiens
GVPAERPWA

SEQ ID NO: 249 - protein, 9 aa, Homo sapiens
ARPEEEKEE

SEQ ID NO: 250 - protein, 9 aa, Homo sapiens
DPPEEEGEM

SEQ ID NO: 251 - protein, 9 aa, Homo sapiens
PDPEELDWG

SEQ ID NO: 252 - protein, 4 aa, Homo sapiens
PPLP

SEQ ID NO: 253 - protein, 7 aa, Homo sapiens
GATGAWS

SEQ ID NO: 254 - protein, 7 aa, Homo sapiens
MFSPLKS

SEQ ID NO: 255 - protein, 7 aa, Homo sapiens
RDTRAGT

SEQ ID NO: 256 - protein, 7 aa, Homo sapiens
VASQPIS

SEQ ID NO: 257 - protein, 7 aa, Homo sapiens
PISFEIS

SEQ ID NO: 258 - protein, 7 aa, Homo sapiens
IQSLMLT

SEQ ID NO: 259 - protein, 7 aa, Homo sapiens
PHSGRLS

SEQ ID NO: 260 - protein, 7 aa, Homo sapiens
LASYRES

SEQ ID NO: 261 - protein, 7 aa, Homo sapiens
RESPNFT

SEQ ID NO: 262 - protein, 7 aa, Homo sapiens
FLTPPET

SEQ ID NO: 263 - protein, 7 aa, Homo sapiens
PGSSSPT

SEQ ID NO: 264 - protein, 7 aa, Homo sapiens
KPSRPKT

SEQ ID NO: 265 - protein, 4 aa, Homo sapiens
EATM

SEQ ID NO: 266 - protein, 4 aa, Homo sapiens
DPTV

SEQ ID NO: 267 - protein, 4 aa, Homo sapiens
EISI

SEQ ID NO: 268 - protein, 4 aa, Homo sapiens
DHTW

SEQ ID NO: 269 - protein, 4 aa, Homo sapiens
EPSA

SEQ ID NO: 270 - protein, 4 aa, Homo sapiens
EPSV

SEQ ID NO: 271 - protein, 7 aa, Homo sapiens
LQVSPIQ

SEQ ID NO: 272 - protein, 7 aa, Homo sapiens
VMFSPLK

SEQ ID NO: 273 - protein, 7 aa, Homo sapiens
LYGSPPG

SEQ ID NO: 274 - protein, 7 aa, Homo sapiens
RDQTPKA

SEQ ID NO: 275 - protein, 7 aa, Homo sapiens
LDASPGA

SEQ ID NO: 276 - protein, 7 aa, Homo sapiens
YRESPNF

SEQ ID NO: 277 - protein, 7 aa, Homo sapiens
GTVSPKK

SEQ ID NO: 278 - protein, 7 aa, Homo sapiens
VFLTPPE

SEQ ID NO: 279 - protein, 7 aa, Homo sapiens
GSSSPTV

SEQ ID NO: 280 - protein, 7 aa, Homo sapiens
HPHSPGL

SEQ ID NO: 281 - protein, 328 aa, Homo sapiens [sequence omitted]

SEQ ID NO: 282 - protein, 236 aa, Homo sapiens; identical to SEQ ID NO: 5

SEQ ID NO: 283 - protein, 17 aa, Homo sapiens
PTEREVSVRRRSGPFAL

SEQ ID NO: 284 - protein, 19 aa, Homo sapiens
LPTEREVSVRRRSGPFALE

SEQ ID NO: 285 - protein, 29 aa, Homo sapiens
FRFDYLPTEREVSVRRRSGPFALEEAEFR

SEQ ID NO: 286 - protein, 17 aa, Homo sapiens
LPTEREVSIWRRSGPFA

SEQ ID NO: 287 - protein, 19 aa, Homo sapiens
YLPTEREVSIWRRSGPFAL

SEQ ID NO: 288 - protein, 29 aa, Homo sapiens
VFRFDYLPTEREVSIWRRSGPFALEEAEF

SEQ ID NO: 289 - protein, 57 aa, Homo sapiens
LVLQVWDYTASLPMTSLDPWSCSYQTWCVGPGAPSSALCSWPAMGPGRGAICFAAAA

SEQ ID NO: 290 - protein, 58 aa, Homo sapiens
VLVLQVWDYTASLPMTSLDPWSCSYQTWCVGPGAPSSALCSWPAMGPGRGAICFAAAA

SEQ ID NO: 291 - protein, 63 aa, Homo sapiens
FRQPAVLVLQVWDYTASLPMTSLDPWSCSYQTWCVGPGAPSSALCSWPAMGPGRGAICFAAAA

SEQ ID NO: 292 - protein, 17 aa, Homo sapiens
MSSDIYVKRWVKGLEHD

SEQ ID NO: 293 - protein, 19 aa, Homo sapiens
EMSSDIYVKRWVKGLEHDK

SEQ ID NO: 294 - protein, 29 aa, Homo sapiens
NPLTGEMSSDIYVKRWVKGLEHDKQETDV

SEQ ID NO: 295 - protein, 17 aa, Homo sapiens
FNWFVNPLNTFVFFIWR

SEQ ID NO: 296 - protein, 19 aa, Homo sapiens
SFNWFVNPLNTFVFFIWRR

SEQ ID NO: 297 - protein, 29 aa, Homo sapiens
SRPKTSFNWFVNPLNTFVFFIWRRYWRTL

SEQ ID NO: 298 - protein, 17 aa, Homo sapiens
NWFVNPLKAFVFFIWRR

SEQ ID NO: 299 - protein, 19 aa, Homo sapiens
FNWFVNPLKAFVFFIWRRY

SEQ ID NO: 300 - protein, 29 aa, Homo sapiens
RPKTSFNWFVNPLKAFVFFIWRRYWRTLV

SEQ ID NO: 301 - protein, 16 aa, Homo sapiens
NWFVNPLNAFVFFIWR

SEQ ID NO: 302 - protein, 18 aa, Homo sapiens
FNWFVNPLNAFVFFIWRR

SEQ ID NO: 303 - protein, 28 aa, Homo sapiens
RPKTSFNWFVNPLNAFVFFIWRRYWRTL

SEQ ID NO: 304 - protein, 16 aa, Homo sapiens
ELVRHLTVDLPEQPYL

SEQ ID NO: 305 - protein, 17 aa, Homo sapiens
ELVRHLTVDLPEQPYLQ

SEQ ID NO: 306 - protein, 28 aa, Homo sapiens
ESPNFTELVRHLTVDLPEQPYLQPPLSI

SEQ ID NO: 307 - protein, 18 aa, Homo sapiens
MVGEIQDQDLQQVPEGRI

SEQ ID NO: 308 - protein, 19 aa, Homo sapiens
SMVGEIQDQDLQQVPEGRI

SEQ ID NO: 309 - protein, 24 aa, Homo sapiens
GVNLISMVGEIQDQDLQQVPEGRI

SEQ ID NO: 310 - protein, 16 aa, Homo sapiens
KLRFLAEEHNFDEDEM

SEQ ID NO: 311 - protein, 17 aa, Homo sapiens
AKLRFLAEEHNFDEDEM

SEQ ID NO: 312 - protein, 28 aa, Homo sapiens
AKKLLAKLRFLAEEHNFDEDEMDDPGDS

SEQ ID NO: 313 - protein, 34 aa, Homo sapiens
LVRVYVVKLRNLCKIQGHEDFCLFSAATNLAPAD

SEQ ID NO: 314 - protein, 36 aa, Homo sapiens
LLVRVYVVKLRNLCKIQGHEDFCLFSAATNLAPADP

SEQ ID NO: 315 - protein, 46 aa, Homo sapiens
NRPIKLLVRVYVVKLRNLCKIQGHEDFCLFSAATNLAPADPNGKAD

SEQ ID NO: 316 - protein, 18 aa, Homo sapiens
GLASQYEVWVQQGPQEPF

SEQ ID NO: 317 - protein, 19 aa, Homo sapiens
CGLASQYEVWVQQGPQEPF

SEQ ID NO: 318 - protein, 24 aa, Homo sapiens
HHRANCGLASQYEVWVQQGPQEPF

SEQ ID NO: 319 - protein, 28 aa, Homo sapiens
GSKVFLTPPETLPPVASGDPEEAQALLV

SEQ ID NO: 320 - protein, 28 aa, Homo sapiens
GSKVFLTPPETLPPVASGDPEEAQALLV

SEQ ID NO: 321 - protein, 28 aa, Homo sapiens
GSKVFLTPPETLPPVASGDPEEAQALLV

SEQ ID NO: 322 - protein, 16 aa, Homo sapiens
VKLKEAEDGKVEAEFE

SEQ ID NO: 323 - protein, 18 aa, Homo sapiens
VVKLKEAEDGKVEAEFEL

SEQ ID NO: 324 - protein, 28 aa, Homo sapiens
RGWWPVVKLKEAEDGKVEAEFELLTVEE

SEQ ID NO: 325 - protein, 2036 aa, Homo sapiens; identical to SEQ ID NO: 29

SEQ ID NO: 326 - protein, 81 aa, Homo sapiens
MCKRRWHWPRSSWQNCAFWLRRHPGQPLVRSVPSWSSSCGWAWASKPRPAPLSCPRICCPSPQPGCPPAYTGTVLEQTLSP

SEQ ID NO: 327 - protein, 82 aa, Homo sapiens
MCKRRWHWPRSSWQNCAFWLRRHPGQPLVRSVPSWSSSCGWAWASKPRPAPLSCPRICCPSPQPGCPPAYTGTVLEQTLSPL

SEQ ID NO: 328 - protein, 87 aa, Homo sapiens
MCKRRWHWPRSSWQNCAFWLRRHPGQPLVRSVPSWSSSCGWAWASKPRPAPLSCPRICCPSPQPGCPPAYTGTVLEQTLSPLWDELL

SEQ ID NO: 329 - protein, 16 aa, Homo sapiens
GISRQLLKHNFDEDEM

SEQ ID NO: 330 - protein, 18 aa, Homo sapiens
AGISRQLLKHNFDEDEMD

SEQ ID NO: 331 - protein, 28 aa, Homo sapiens
PFLAEAGISRQLLKHNFDEDEMDDPGDS

SEQ ID NO: 332 - protein, 18 aa, Homo sapiens
GLASQYEVWVQQGPQEPF

SEQ ID NO: 333 - protein, 19 aa, Homo sapiens
CGLASQYEVWVQQGPQEPF

SEQ ID NO: 334 - protein, 24 aa, Homo sapiens
HHRANCGLASQYEVWVQQGPQEPF

SEQ ID NO: 335 - DNA, 2918 bp, Homo sapiens; identical to SEQ ID NO: 4

SEQ ID NO: 336 - DNA, 1954 bp, Homo sapiens
vtttttttatgaaacagtctcgctctgtctcccaggttggagtgcagtggcacgatctcggvctgactgcaacctccacctcctgggttcaagcgattctcctgcctcagcctccccagtagvctgggattacaggcgtgggcccccatgtccagctaatttttatattttcgctctgtctccvcaggttggagtgcagtggcacgatctcggctgactgcaacctccacctcctgggttcaagvcgattctcctgcctcagcctccccagtagctgggattacaggcgtgggcccccatgtccavgctaatttttatatttttagtagagacagggtttcaccatgttgtccaggctggtcttgavacccctgacctcaagtgatccacccacctctgcctcccaaagtgctgggattacaggtgtvgagccaccatgccaggccctcttaacctcttcaagtctgttttctcatctgcaaaacagavggtaataagatcagtatcttcttaatggaagcacctggactacatttttttcattcattgvttatcataaatgaggactaacctgtctcccgttgggagttttgaacctagacctcatgtcvttcatgacgtcatcactgccccaggcccagctgtgtccctacaccagccccagctgacgcvatcttctttttctgcctgtagagatggttacaatgcctggcgtgatgcattctggccttcvgcagatcctggcggggctgtgccaacgctgtggcctccctgcccctgaataccgagccggvtgctgtcaaggtgggcagcaaagtcttcctgacaccaccggagaccctgcccccagggatvctcttcacatgtggattgacatctttcctcaagatgtgcctgctccacccccagttgacavtcaagcctcggcagccaatcagctatgagctcagagttgtcatctggaacacggaggatgvtggttctggatgacgagaatccactcaccggagagatgtcgagtgacatctatgtgaagavgctgggtgaaggggttggagcatgacaagcaggagacagacgttcacttcaactccctgavctggggaggggaacttcaattggcgctttgtgttccgctttgactacctgcccacggagcvgggaggtgagcgtctggcgcaggtctggaccctttgccctggaggaggcggagttccggcvagcctgcagtgctggtcctgcaggvggatccctggagttgcagctaccagacatggtgcgtggggcccggggccccgagctctgcvtctgtgcagctggcccgcaatggggccgggccgaggtgcaatctgtttcgctgccgccgcvctgaggggctggtggccggtagtgaagctgaaggaggcagaggacgtggagcgggaggcgvcaggaggctcaggctggcaagaagaagcgaaagcagaggaggaggaagggccggccagaavgacctggagttcacagacatgggtggcaatgtgtacatcctcacgggcaaggtggaggcavgagtttgagctgctgactgtggaggaggccgagaaacggccagtggggaaggggcggaagvcagccagagcctctggagaaacccagccgccccaaaacttccttcaactggtttgtgaacvccgctgaagacctttgtcttcttcatctggcgccggtactggcgcaccctggtgctgctgvctactggtgctgctcaccgtcttcctcctcctggtcttctacaccatccctggccagatcvagccaggtcatcttccgtcccctccacaagtgactctcgctgaccttggacactcacccavgggtgccaacccttcaatgcctgctcctggaagtctttcttacccatgtgagctaccccavgagtctagtgcttcctctgaataaacctatcacagcc

SEQ ID NO: 337 - DNA, 1954 bp, Homo sapiens
vtttttttatgaaacagtctcgctctgtctcccaggttggagtgcagtggcacgatctcggvctgactgcaacctccacctcctgggttcaagcgattctcctgcctcagcctccccagtagvctgggattacaggcgtgggcccccatgtccagctaatttttatattttcgctctgtctccvcaggttggagtgcagtggcacgatctcggctgactgcaacctccacctcctgggttcaagvcgattctcctgcctcagcctccccagtagctgggattacaggcgtgggcccccatgtccavgctaatttttatatttttagtagagacagggtttcaccatgttgtccaggctggtcttgavacccctgacctcaagtgatccacccacctctgcctcccaaagtgctgggattacaggtgtvgagccaccatgccaggccctcttaacctcttcaagtctgttttctcatctgcaaaacagavggtaataagatcagtatcttcttaatggaagcacctgggctacatttttttcattcattgvttatcataaatgaggactaacctgtctcccgttgggagttttgaacctagacctcatgtcvttcatgacgtcatcactgccccaggcccagctgtgtccctacaccagccccagctgacgcvatcttctttttctgcctgtagagatggttacaatgcctggcgtgatgcattctggccttcvgcagatcctggcggggctgtgccaacgctgtggcctccctgcccctgaataccgagccggvtgctgtcaaggtgggcagcaaagtcttcctgacaccaccggagaccctgcccccagggatvctcttcacatgtggattgacatctttcctcaagatgtgcctgctccacccccagttgacavtcaagcctcggcagccaatcagctatgagctcagagttgtcatctggaacacggaggatgvtggttctggatgacgagaatccactcaccggagagatgtcgagtgacatctatgtgaagavgctgggtgaaggggttggagcatgacaagcaggagacagacgttcacttcaactccctgavctggggaggggaacttcaattggcgctttgtgttccgctttgactacctgcccacggagcvgggaggtgagcgtctggcgcaggtctggaccctttgccctggaggaggcggagttccggcvagcctgcagtgctggtcctgcaggvggatccctggagttgcagctaccagacatggtgcgtggggcccggggccccgagctctgcvtctgtgcagctggcccgcaatggggccgggccgaggtgcaatctgtttcgctgccgccgcvctgaggggctggtggccggtagtgaagctgaaggaggcagaggacgtggagcgggaggcgvcaggaggctcaggctggcaagaagaagcgaaagcagaggaggaggaagggccggccagaavgacctggagttcacagacatgggtggcaatgtgtacatcctcacgggcaaggtggaggcavgagtttgagctgctgactgtggaggaggccgagaaacggccagtggggaaggggcggaagvcagccagagcctctggagaaacccagccgccccaaaacttccttcaactggtttgtgaacvccgctgaagacctttgtcttcttcatctggcgccggtactggcgcaccctggtgctgctgvctactggtgctgctcaccgtcttcctcctcctggtcttctacaccatccctggccagatcvagccaggtcatcttccgtcccctccacaagtgactctcgctgaccttggacactcacccavgggtgccaacccttcaatgcctgctcctggaagtctttcttacccatgtgagctaccccavgagtctagtgcttcctctgaataaacctatcacagcc

SEQ ID NO: 338 - protein, 236 aa, Homo sapiens; identical to SEQ ID NO: 5

SEQ ID NO: 339 - protein, 181 aa, Homo sapiens [sequence omitted]

SEQ ID NO: 340 - protein, 185 aa, Homo sapiens
VMVRGARGPELCSVQLARNGAGPRCNLFRCRRLRGWWPVVKLKEAEDVEREAQEAQAGKKKVRKQRRRKGRPEDLEFTDMGGNVYILTGKVEAEFELLTVEEAEKRPVGKGRKQPEPLEKPSVRPKTSFNWFVNPLKTFVFFIWRRYWRTLVLLLLVLLTVFLLLVFYTIPGQISQVIFRPLHVK

SEQ ID NO: 341 - protein, 185 aa, Homo sapiens; identical to SEQ ID NO: 340

SEQ ID NO: 342 - DNA, 7108 bp, Homo sapiens; identical to SEQ ID NO: 22

SEQ ID NO: 343 - DNA, 1995 bp, Homo sapiens
vtttttttatgaaacagtctcgctctgtctcccaggttggagtgcagtggcacgatctcggvctgactgcaacctccacctcctgggttcaagcgattctcctgcctcagcctccccagtagvctgggattacaggcgtgggcccccatgtccagctaatttttatattttcgctctgtctccvcaggttggagtgcagtggcacgatctcggctgactgcaacctccacctcctgggttcaagvcgattctcctgcctcagcctccccagtagctgggattacaggcgtgggcccccatgtccavgctaatttttatatttttagtagagacagggtttcaccatgttgtccaggctggtcttgavacccctgacctcaagtgatccacccacctctgcctcccaaagtgctgggattacaggtgtvgagccaccatgccaggcccacttaacctcttcaagtctgttttctcatctgcaaaacagavggtaataagatcagtatcttcttaatggaagcacctgggctacatttttttcattcattgvttatcataaatgaggactaacctgtctcccgttgggagttttgaacctagacctcatgtcvttcatgacgtcatcactgccccaggcccagctgtgtccctacaccagccccagctgacgcvatcttctttttctgcctgtagagatggttacaatgcctggcgtgatgcattctggccttcvgcagatcctggcggggctgtgccaacgctgtggcctccctgcccctgaataccgagccggvtgctgtcaaggtgggcagcaaagtcttcctgacaccaccggagaccctgcccccagggatvctcttcacatgtggattgacatctttcctcaagatgtgcctgctccacccccagttgacavtcaagcctcggcagccaatcagctatgagctcagagttgtcatctggaacacggaggatgvtggttctggacgacgagaatccactcaccggagagatgtcgagtgacatctatgtgaagavgvagctgggtgaaggggttggagcatgacaagcaggagacagacgttcacttcaactccctgvactggggaggggaacttcaattggcgctttgtgttccgctttgactacctgcccacggagvcgggaggtgagcatccggcgcaggtctggaccctttgccctggaggaggcggagttccggvcagcctgcagtgctggtcctgcaggtctgggactatgaccgcatctctgccaatgacttcvcttggatccctggagttgcagctaccagacatggtgcgtggggcccggggccccgagctcvtgctctgtgcagctggcccgcaatggggccgggccgaggtgcaatctgtttcgctgccgcvcgcctgaggggctggtggccggtagtgaagctgaaggaggcagaggacgtggagcgggagvgcgcaggaggctcaggctggcaagaagaagcgaaagcagaggaggaggaagggccggccavgaagacctggagttcacagacatgggtggcaatgtgtacatcctcacgggcaaggtggagvgcagagtttgagctgctgactgtggaggaggccgagaaacggccagtggggaaggggcggvaagcagccagagcctctggagaaacccagccgccccaaaacttccttcaactggtttgtgvaacccgctgaagacctttgtcttcttcatctggcgccggtactggcgcaccctggtgctgvctgctactggtgctgctcaccgtcttcctcctcctggtcttctacaccatccctggccagvatcagccaggtcatcttccgtcccctccacaagtgactctcgctgaccttggacactcacvccagggtgccaacccttcaatgcctgctcctggaagtctttcttacccatgtgagctaccvccagagtctagtgcttcctctgaataaacctatcacagcc

SEQ ID NO: 344 - DNA, 1995 bp, Homo sapiens
vtttttttatgaaacagtctcgctctgtctcccaggttggagtgcagtggcacgatctcggvctgactgcaacctccacctcctgggttcaagcgattctcctgcctcagcctccccagtagvctgggattacaggcgtgggcccccatgtccagctaatttttatattttcgctctgtctccvcaggttggagtgcagtggcacgatctcggctgactgcaacctccacctcctgggttcaagvcgattctcctgcctcagcctccccagtagctgggattacaggcgtgggcccccatgtccavgctaatttttatatttttagtagagacagggtttcaccatgttgtccaggctggtcttgavacccctgacctcaagtgatccacccacctctgcctcccaaagtgctgggattacaggtgtvgagccaccatgccaggccctcttaacctcttcaagtctgttttctcatctgcaaaacagavggtaataagatcagtatcttcttaatggaagcacctggactacatttttttcattcattgvttatcataaatgaggactaacctgtctcccgttgggagttttgaacctagacctcatgtcvttcatgacgtcatcactgccccaggcccagctgtgtccctacaccagccccagctgacgcvatcttctttttctgcctgtagagatggttacaatgcctggcgtgatgcattctggccttcvgcagatcctggcggggctgtgccaacgctgtggcctccctgcccctgaataccgagccggvtgctgtcaaggtgggcagcaaagtcttcctgacaccaccggagaccctgcccccagggatvctcttcacatgtggattgacatctttcctcaagatgtgcctgctccacccccagttgacavtcaagcctcggcagccaatcagctatgagctcagagttgtcatctggaacacggaggatgvtggttctggatgacgagaatccactcaccggagagatgtcgagtgacatctatgtgaagavgvagctgggtgaaggggttggagcatgacaagcaggagacagacgttcacttcaactccctgvactggggaggggaacttcaattggcgctttgtgttccgctttgactacctgcccacggagvcgggaggtgagcgtctggcgcaggtctggaccctttgccctggaggaggcggagttccggvcagcctgcagtgctggtcctgcaggtctgggactatgaccgcatctctgccaatgacttcvcttggatccctggagttgcagctaccagacatggtgcgtggggcccggggccccgagctcvtgctctgtgcagctggcccgcaatggggccgggccgaggtgcaatctgtttcgctgccgcvcgcctgaggggctggtggccggtagtgaagctgaaggaggcagaggacgtggagcgggagvgcgcaggaggctcaggctggcaagaagaagcgaaagcagaggaggaggaagggccggccavgaagacctggagttcacagacatgggtggcaatgtgtacatcctcacgggcaaggtggagvgcagagtttgagctgctgactgtggaggaggccgagaaacggccagtggggaaggggcggvaagcagccagagcctctggagaaacccagccgccccaaaacttccttcaactggtttgtgvaacccgctgaagacctttgtcttcttcatctggcgccggtactggcgcaccctggtgctgvctgctactggtgctgctcaccgtcttcctcctcctggtcttctacaccatccctggccagvatcagccaggtcatcttccgtcccctccacaagtgactctcgctgaccttggacactcacvccagggtgccaacccttcaatgcctgctcctggaagtctttcttacccatgtgagctaccvccagagtctagtgcttcctctgaataaacctatcacagcc

SEQ ID NO: 345 - protein, 1393 aa, Homo sapiens; identical to SEQ ID NO: 23

SEQ ID NO: 346 - DNA, 6303 bp, Homo sapiens; identical to SEQ ID NO: 24

SEQ ID NO: 347 - DNA, 1998 bp, Homo sapiens
vtttttttatgaaacagtctcgctctgtctcccaggttggagtgcagtggcacgatctcggvctgactgcaacctccacctcctgggttcaagcgattctcctgcctcagcctccccagtagvctgggattacaggcgtgggcccccatgtccagctaatttttatattttcgctctgtctccvcaggttggagtgcagtggcacgatctcggctgactgcaacctccacctcctgggttcaagvcgattctcctgcctcagcctccccagtagctgggattacaggcgtgggcccccatgtccavgctaatttttatatttttagtagagacagggtttcaccatgttgtccaggctggtcttgavacccctgacctcaagtgatccacccacctctgcctcccaaagtgctgggattacaggtgtvgagccaccatgccaggccctcttaacctcttcaagtctgttttctcatctgcaaaacagavggtaataagatcagtatcttcttaatggaagcacctggactacatttttttcattcattgvttatcataaatgaggactaacctgtctcccgttgggagttttgaacctagacctcatgtcvttcatgacgtcatcactgccccaggcccagctgtgtccctacaccagccccagctgacgcvatcttctttttctgcctgtagagatggttacaatgcctggcgtgatgcattctggccttcvgcagatcctggcggggctgtgccaacgctgtggcctccctgcccctgaataccgagccggvtgctgtcaaggtgggcagcaaagtcttcctgacaccaccggagaccctgcccccagggatvctcttcacatgtggattgacatctttcctcaagatgtgcctgctccacccccagttgacavtcaagcctcggcagccaatcagctatgagctcagagttgtcatctggaacacggaggatgvtggttctggatgacgagaatccactcaccggagagatgtcgagtgacatctatgtgaagavgvggatccctggagttgcagctaccagacatggtgcgtggggcccggggccccgagctctgcvtctgtgcagctggcccgcaatggggccgggccgaggtgcaatctgtttcgctgccgccgcvctgaggggctggtggccggtagtgaagctgaaggaggcagaggacgtggagcgggaggcgvcaggaggctcaggctggcaagaagaagcgaaagcagaggaggaggaagggccggccagaavgacctggagttcacagacatgggtggcaatgtgtacatcctcacgggcaaggtggaggcavgagtttgagctgctgactgtggaggaggccgagaaacggccagtggggaaggggcggaagvcagccagagcctctggagaaacccagccgccccaaaacttccttcaactggtttgtgaacvccgctgaagacctttgtcttcttcatctggcgccggtactggcgcaccctggtgctgctgvctactggtgctgctcaccgtcttcctcctcctggtcttctacaccatccctggccagatcvagccaggtcatcttccgtcccctccacaagtgactctcgctgaccttggacactcacccavgggtgccaacccttcaatgcctgctcctggaagtctttcttacccatgtgagctaccccavgagtctagtgcttcctctgaataaacctatcacagccvagctgggtgaaggggttggagcatgacaagcaggagacagacgttcacttcaactccctgvactggggaggggaacttcaattggcgctttgtgttccgctttgactacctgcccacggagvcgggaggtgagcgtctggcgcaggtctggaccctttgccctggaggaggcggagttccggvcagcctgcagtgctggtcctgcaggtctgggactatgaccgcatctctgccaatgacttcvcttgg

SEQ ID NO: 348 - DNA, 1998 bp, Homo sapiens; identical to SEQ ID NO: 347

SEQ ID NO: 349 - protein, 1145 aa, Homo sapiens [sequence omitted]

SEQ ID NO: 350 - DNA, 6161 bp, Homo sapiens; identical to SEQ ID NO: 26

SEQ ID NO: 351 - DNA, 1182 bp, Homo sapiens
vcagggatctcttcacatgtggattgacatctttcctcaagatgtgcctgctccacccccavgttgacatcaagcctcggcagccaatcagctatgagctcagagttgtcatctggaacacgvgaggatgtggttctggatgacgagaatccactcaccggagagatgtcgagtgacatctatvgtgaagagctgggtgaaggggttggagcatgacaagcaggagacagacgttcacttcaacvtccctgactggggaggggaacttcaattggcgctttgtgttccgctttgactacctgcccvacggagcgggaggtgagcgtctggcgcaggtctggaccctttgccctggaggaggcggagvttccggcagcctgcagtgctggtcctgcaggtctgggactatgaccgcatctctgccaatvgacttccttggatccctggagttgcagctaccagacatggtgcgtggggcccggggccccvgagctctgctctgtgcagctggcccgcaatggggccgggccgaggtgcaatctgtttcgcvtgccgccgcctgaggggctggtggccggtagtgaagctgaaggaggcagaggacgvggcaaggtggaggcagagtttgagctgctgactgtggaggaggccgagaaacggccagtgvgggaaggggcggaagcagccagagcctctggagaaacccagccgccccaaaacttccttcvaactggtttgtgaacccgctgaagacctttgtcttcttcatctggcgccggtactggcgcvaccctggtgctgctgctactggtgctgctcaccgtcttcctcctcctggtcttctacaccvatccctggccagatcagccaggtcatcttccgtcccctccacaagtgactctcgctgaccvttggacactcacccagggtgccaacccttcaatgcctgctcctggaagtctttcttacccvatgtgagctaccccagagtctagtgcttcctctgaataaacctatcacagccvagatggttacaatgcctggcgtgatgcattctggccttcgcagatcctggcggggctgtgvccaacgctgtggcctccctgcccctgaataccgagccggtgctgtcaaggtgggcagcaavagtcttcctgacaccaccggagaccctgcccccag

SEQ ID NO: 352 - DNA, 1182 bp, Homo sapiens; identical to SEQ ID NO: 351

SEQ ID NO: 353 - protein, 1990 aa, Homo sapiens; identical to SEQ ID NO: 27

SEQ ID NO: 354 - protein, 334 aa, Homo sapiens
VMWIDIFPQDVPAPPPVDIKPRQPISYELRVVIWNTEDVVLDDENPLTGEMSSDIYVKSWVVKGLEHDKQETDVHFNSLTGEGNFNWRFVFRFDYLPTEREVSVWRRSGPFALEEAEFRQPAVVLVLQVWDYDRISANDFLGSLELQLPDMVRGARGPELCSVQLARNGAGPRCNLFRCRRLRVGWWPVVKLKEAEDVEREAQEAQAGKKKRKQRRRKGRPEDLEFTDMGGNVYILTGKVEAEFVELLTVEEAEKRPVGKGRKQPEPLEKPSRPKTSFNWFVNPLKTFVFFIWRRYWRTLVLLLLVVLLTVFLLLVFYTIPGQISQVIFRPLHK

SEQ ID NO: 355 - protein, 294 aa, Homo sapiens
VMWIDIFPQDVPAPPPVDIKPRQPISYELRVVIWNTEDVVLDDENPLTGEMSSDIYVKSWVVKGLEHDKQETDVHFNSLTGEGNFNWRFVFRFDYLPTEREVSVWRRSGPFALEEAEFRQPAVVLVLQVWDYDRISANDFLGSLELQLPDMVRGARGPELCSVQLARNGAGPRCNLFRCRRLRVGWWPVVKLKEAEDGKVEAEFVELLTVEEAEKRPVGKGRKQPEPLEKPSRPKTSFNWFVNPLKTFVFFIWRRYWRTLVLLLLVVLLTVFLLLVFYTIPGQISQVIFRPLHK

SEQ ID NO: 356 - DNA, 6299 bp, Homo sapiens; identical to SEQ ID NO: 28

SEQ ID NO: 357 - DNA, 1304 bp, Homo sapiens
vcagggatctcttcacatgtggattgacatctttcctcaagatgtgcctgctccacccccavgttgacatcaagcctcggcagccaatcagctatgagctcagagttgtcatctggaacacgvgaggatgtggttctggatgacgagaatccactcaccggagagatgtcgagtgacatctatvgtgaagagctgggtgaaggggttggagcatgacaagcaggagacagacgttcacttcaacvtccctgactggggaggggaacttcaattggcgctttgtgttccgctttgactacctgcccvacggagcgggaggtgagcgtctggcgcaggtctggaccctttgccctggaggaggcggagvttccggcagcctgcagtgctggtcctgcaggtctgggactatgaccgcatctctgccaatvgacttccttggatccctggagttgcagctaccagacatggtgcgtggggcccggggccccvgagctctgctctgtgcagctggcccgcaatggggccgggccgaggtgcaatctgtttcgcvtgccgccgcctgaggggctggtggccggtagtgaagctgaaggaggcagaggacgtggagvcgggaggcgcaggaggctcaggctggcaagaagaagcgaaagcagaggaggaggaagggcvcggccagaagacctggagttcacagacatgggtggcaatgtgtacatcctcacgggcaagvgtggaggcagagtttgagctgctgactgtggaggaggccgagaaacggccagtggggaagvgggcggaagcagccagagcctctggagaaacccagccgccccaaaacttccttcaactggvtttgtgaacccgctgaagacctttgtcttcttcatctggcgccggtactggcgcaccctgvgtgctgctgctactggtgctgctcaccgtcttcctcctcctggtcttctacaccatccctvggccagatcagccaggtcatcttccgtcccctccacaagtgactctcgctgaccttggacvactcacccagggtgccaacccttcaatgcctgctcctggaagtctttcttacccatgtgavgctaccccagagtctagtgcttcctctgaataaacctatcacagccvagatggttacaatgcctggcgtgatgcattctggccttcgcagatcctggcggggctgtgvccaacgctgtggcctccctgcccctgaataccgagccggtgctgtcaaggtgggcagcaavagtcttcctgacaccaccggagaccctgcccccagg

SEQ ID NO: 358 - DNA, 1304 bp, Homo sapiens; identical to SEQ ID NO: 357

SEQ ID NO: 359 - protein, 2036 aa, Homo sapiens; identical to SEQ ID NO: 29

SEQ ID NO: 360 - protein, 334 aa, Homo sapiens; identical to SEQ ID NO: 354

SEQ ID NO: 361 - protein, 329 aa, Homo sapiens
VMWIDIFPQDVPAPPPVDIKPRQPISYELRVVIWNTEDVVLDDENPLTGEMSSDIYVKSWVKGLEHDKQETDVHFNSLTGEGNFNWRFVFRFDYLPTEREVSVWRRSGPFALEEAEFRQPAVLVLQVWDYDRISANDFLGSLELQLPDMVRGARGPELCSVQLARNGAGPRCNLFRCRRLRGWWPVVKLKEAEDVEREAQEAQAGKKKRKQRRRKGRPEDLEFTDMGGNVYILTGKVEAEFELLTVEEAEKRPVGKGRKQPEPLEKPSRPKTSFNWFVNPLKTFVFFIWRRYWRTLVLLLLVLLTVFLLLVFYTIPGQISQVIFRPLHK

SEQ ID NO: 362 - DNA, 6855 bp, Homo sapiens; identical to SEQ ID NO: 30

SEQ ID NO: 363 - DNA, 1954 bp, Homo sapiens; identical to SEQ ID NO: 336

SEQ ID NO: 364 - DNA, 1954 bp, Homo sapiens; identical to SEQ ID NO: 336

SEQ ID NO: 365 - protein, 610 aa, Homo sapiens; identical to SEQ ID NO: 31

The invention claimed is:

1. An isolated polynucleotide that encodes a 158P3D2 protein, wherein the polynucleotide is selected from the group consisting of:
   (a) a polynucleotide comprising the sequence of SEQ ID NO:2, from nucleotide residue numbers 1 through 849, wherein the nucleotide residue at 150 is G;
   (b) a polynucleotide comprising the sequence of SEQ ID NO:2, from nucleotide residue numbers 849 through 1835, wherein the nucleotide residue at 1022 is A;
   (c) a polynucleotide comprising the sequence of SEQ ID NO:2, from nucleotide residue numbers 849 through 1835, wherein the nucleotide residue at 1148 is A;
   (d) a polynucleotide comprising the sequence of SEQ ID NO:2, from nucleotide residue numbers 849 through 1835, wherein the nucleotide residue at 1691 is T; and
   (e) a polynucleotide comprising the sequence of SEQ ID NO:2, from nucleotide residue numbers 849 through 1835, wherein the nucleotide residue at 1692 is G.

2. An isolated polynucleotide that is the full complement to the polynucleotide of claim 1.

3. The polynucleotide of claim 1 that encodes the polypeptide sequence shown in SEQ ID NO:3 wherein S58R, K281N, or T282A.

4. A recombinant expression vector comprising the polynucleotide of claim 1.

5. An isolated host cell that contains the expression vector of claim 4.

6. A process for producing a 158P3D2 protein comprising culturing the host cell of claim 5 under conditions sufficient for the production of the 158P3D2 protein.

7. The process of claim 6, further comprising recovering the 158P3D2 protein so produced.

8. The process of claim 6, wherein the protein is recovered using chromatography.

* * * * *